US008951937B2

(12) United States Patent
Flint et al.

(10) Patent No.: US 8,951,937 B2
(45) Date of Patent: Feb. 10, 2015

(54) IDENTIFICATION AND USE OF BACTERIAL [2FE-2S] DIHYDROXY-ACID DEHYDRATASES

(71) Applicant: Butamax(TM) Advanced Biofuels LLC, Wilmington, DE (US)

(72) Inventors: Dennis Flint, Newark, DE (US); Steven Cary Rothman, Wilmington, DE (US); Wonchul Suh, Hockessin, DE (US); Jean-Francois Tomb, Wilmington, DE (US); Rick W. Ye, Hockessin, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 0 days.

(21) Appl. No.: 13/838,508

(22) Filed: Mar. 15, 2013

(65) Prior Publication Data

US 2014/0030776 A1 Jan. 30, 2014

Related U.S. Application Data

(63) Continuation of application No. 12/569,636, filed on Sep. 29, 2009.

(60) Provisional application No. 61/100,792, filed on Sep. 29, 2008.

(51) Int. Cl.
| | | |
|---|---|---|
| *C40B 30/00* | (2006.01) | |
| *C12P 21/00* | (2006.01) | |
| *G06F 19/22* | (2011.01) | |
| *C12P 7/16* | (2006.01) | |
| *C12P 7/40* | (2006.01) | |
| *C12P 13/06* | (2006.01) | |
| *C12P 13/08* | (2006.01) | |
| *C12N 1/21* | (2006.01) | |
| *C12N 1/19* | (2006.01) | |
| *C12N 9/88* | (2006.01) | |
| *C12N 15/00* | (2006.01) | |
| *C12N 5/10* | (2006.01) | |

(52) U.S. Cl.
CPC ...... *G06F 19/22* (2013.01); *C12N 9/88* (2013.01); *C12P 7/16* (2013.01); *C12P 7/40* (2013.01); *C12P 13/06* (2013.01); *C12P 13/08* (2013.01); *C12Y 402/01009* (2013.01); *Y02E 50/10* (2013.01)
USPC ........... 506/7; 435/232; 435/69.1; 435/320.1; 435/252.3; 435/325; 435/252.31; 435/252.32; 435/252.33; 435/252.34; 435/252.35; 435/254.2; 435/254.21; 435/254.22; 435/254.23

(58) Field of Classification Search
USPC .................. 435/232, 69.1, 320.1, 325, 252.3
See application file for complete search history.

(56) References Cited

U.S. PATENT DOCUMENTS

| | | |
|---|---|---|
| 4,683,202 A | 7/1987 | Mullis |
| 5,643,779 A | 7/1997 | Ehrlich et al. |
| 6,177,264 B1 | 1/2001 | Eggeling et al. |
| 6,699,703 B1 | 3/2004 | Doucette-Stamm et al. |
| 7,851,188 B2 | 12/2010 | Donaldson et al. |
| 8,241,878 B2 | 8/2012 | Anthony et al. |
| 8,455,224 B2 | 6/2013 | Paul et al. |
| 2003/0166179 A1 | 9/2003 | Rajgarhia et al. |
| 2007/0031918 A1 | 2/2007 | Dunson, Jr. et al. |
| 2007/0092957 A1 | 4/2007 | Donaldson et al. |
| 2007/0292927 A1 | 12/2007 | Donaldson et al. |
| 2008/0261230 A1 | 10/2008 | Liao et al. |
| 2009/0305363 A1 | 12/2009 | Anthony et al. |
| 2009/0305370 A1 | 12/2009 | Grady et al. |
| 2010/0081154 A1 | 4/2010 | Flint et al. |
| 2010/0081179 A1 | 4/2010 | Anthony et al. |
| 2010/0081182 A1 | 4/2010 | Paul et al. |
| 2010/0081183 A1 | 4/2010 | Paul et al. |
| 2010/0129886 A1 | 5/2010 | Anthony et al. |
| 2011/0076733 A1 | 3/2011 | Urano et al. |
| 2011/0124060 A1 | 5/2011 | Anthony et al. |
| 2011/0136193 A1 | 6/2011 | Grady et al. |
| 2011/0159558 A1 | 6/2011 | Grady et al. |
| 2011/0244536 A1 | 10/2011 | Nagarajan et al. |
| 2011/0287500 A1 | 11/2011 | Urano et al. |
| 2012/0064585 A1 | 3/2012 | Anthony et al. |

FOREIGN PATENT DOCUMENTS

| | | |
|---|---|---|
| EP | 1 887 081 A2 | 2/2008 |
| WO | WO 2006/059111 A2 | 6/2006 |
| WO | WO 2007/020992 A1 | 2/2007 |
| WO | WO 2007/106524 A2 | 9/2007 |
| WO | WO 2008/098227 A2 | 8/2008 |

(Continued)

OTHER PUBLICATIONS

"Dihydroxy-Acid Dehydratase" in *Springer Handbook of Enzymes*, vol. 4, Lyases II, 2$^{nd}$ Ed., Schomburg, D., et al., Eds., pp. 296-303, Springer-Verlag, Germany (2002).
Aden et al., "Lignocellulosic Biomass to Ethanol Process Design and Economics Utilizing Co-Current Dilute Acid Prehydrolysis and Enzymatic Hydrolysis for Corn Stover," Report NREL/TP-510-32438, National Renewable Energy Laboratory, Jun. 2002.
Altschul, S.F., et al., "Basic Local Alignment Search Tool," *J. Mol. Biol.* 215:403-410, Academic Press, England (1990).
Arthur, M., et al., "Contribution of VanY D,D-Carboxypeptidase to Glycopeptide Resistance in *Enterococcus faecalis* by Hydrolysis of Peptidoglycan Precursors," *Antimicrob. Agents Chemother.* 38:1899-1903, American Society for Microbiology, United States (1994).
Bellion et al., Microb. Growth C1 Compd., [Int. Symp.], 7th, 415-32. Murrell, J.C. and Kelly, D.P., Eds., Intercept, England (1993).

(Continued)

*Primary Examiner* — Delia Ramirez

(57) ABSTRACT

A group of bacterial dihydroxy-acid dehydratases having a [2Fe-2S] cluster was discovered. Bacterial [2Fe-2S] DHADs were expressed as heterologous proteins in bacteria and yeast cells, providing DHAD activity for conversion of 2,3-dihydroxyisovalerate to α-ketoisovalerate or 2,3-dihydroxymethylvalerate to α-ketomethylvalerate. Isobutanol and other compounds may be synthesized in pathways that include bacterial [2Fe-2S] DHAD activity.

7 Claims, 10 Drawing Sheets

(56) References Cited

FOREIGN PATENT DOCUMENTS

| WO | WO 2009/086423 A2 | 7/2009 |
|---|---|---|
| WO | WO 2009/103533 A1 | 8/2009 |

OTHER PUBLICATIONS

Branden, C., et al., *Introduction to Protein Structure*, Vella, F., Ed., p. 247, Garland Publishing Inc., New York, United States (1991).

Chen, S., et al., "Role of NifS in Maturation of Glutamine Phosphoribosylpyrophosphate Amidotransferase," *J. Bacteriol.* 179(23):7587-7590, American Society of Microbiology, United States (1997).

Chica, R.A., et al. "Semi-rational approaches to engineering enzyme activity: combining the benefits of directed evolution and rational design," *Curr. Opin. Biotechnol.* 16:378-384, Elsevier Ltd., England (2005).

Connor, M.R. and Liao, J.C., "Engineering of an *Escherichia coli* Strain for the Production of 3-Methyl-1-Butanol," *Appl. Environ. Microbiol.* 74(18):5769-5775, American Society for Microbiology, United States (2008).

Deshpande, M.V., "Ethanol production from cellulose by coupled saccharification/fermentation using *Saccharomyces cerevisiae* and cellulase complex from *Sclerotium rolfsii* UV-8 mutant," *Appl. Biochem. Biotechnol.* 36:227-234, Humana Press, United States (1992).

Dickinson, J.R., et al., "Investigative of the Metabolism of Valine to Isobutyl Alcohol in *Saccharomyces cerevisiae*," *J. Biol. Chem.* 273(40): 25751-25756, American Society for Biochemistry and Molecular Biology, United States (1998).

Dürre, P., "New insights and novel developments in clostridial acetone/butanol/isopropanol fermentation," *Appl Microbiol Biotechnol* 49:639-648, Springer-Verlag, Germany (1998).

Eden, A., et al., "Involvement of branched-chain amino acid aminotransferases in the production of fusel alcohols during fermentation in yeast," *Appl. Microbiol. Biotechnol.* 55:296-300, Springer-Verlag, Germany (2001).

Eichenbaum, Z., et al., "Use of the Lactococcal nisA Promoter to Regulate Gene Expression in Gram-Positive Bacteria: Comparison of Induction Level and Promoter Strength," *Appl. Environ. Microbiol.* 64(8):2763-2769, American Society for Microbiology, United States (1998).

Flint, D.H. and Emptage, M.H., "Dihydroxy Acid Dehydratase from Spinach Contains a [2Fe-2S] Cluster," *J Biol. Chem.* 263(8):3558-3564, American Society for Biochemistry and Molecular Biology, United States (1988)

Flint, D.H., et al., "The Role and Properties of the Iron-Sulfur in *Escherichia coli* Dihydroxy-acid Dehydratase," *J. Biol. Chem.* 268 (20):14732-14742, American Society for Biochemistry and Molecular Biology, Inc., United States (1993).

Flint, D.H., "*Escherichia coli* Contains a Protein That Is Momologous in Function and N-terminal Sequence to the Protein Encoded by the nifS Gene of *Azotobacter vinelandii* and That Can Participate in the Synthesis of the Fe-S Cluster of Dihydroxy-acid Dehydratase," *J. Biol. Chem.* 271(27):16068-16074, The American Society for Biochemistry and Molecular Biology, Inc., United States (1996).

Flint, D.H. and Nudelman, A., "Studies on the Active Site of Dihydroxy-acid Dehydratase," *Bioorganic Chem.* 21:367-385, Academic Press, United States (1993).

Flint, D.H., et al., "The Inactivation of Fe-S Cluster Containing Hydro-lyases by Superoxide," *J. Biol. Chem.* 268(30):22369-22376, American Society for Biochemistry and Molecular Biology, United States (1993).

Frohman, M.A., et al., "Rapid production of full-length cDNAs from rare transcripts: Amplification using a single gene-specific oligonucleotide primer," *Proc. Natl. Acad. Sci. USA* 85:8998-9002, National Academy of Sciences, (1988).

Fujimoto, S., and Ike, Y., "pAM401-Based Shuttle Vectors That Enable Overexpression of Promoterless Genes and One-Step Purification of Tag Fusion Proteins Directly from *Enterococcus faecalis*," *Appl. Environ. Microbiol.* 67(3):1262-1267, American Society for Microbiology, United States (2001).

Gellissen, G., et al., "Heterologous protein production in yeast,"*Antonie van Leeuwenhoek* 62:79-93, Kluwer Academic Publishers, Netherlands (1992).

Godon, J-J., et al., "Branched-Chain Amino Acid Biosynthesis Genes in *Lactococcus lactis* subsp. *lactis*," *J. Bacteriol.* 174(20):6580-6589, American Society for Microbiology, United States (1992).

Goossens, E., et al., "Control of diacetyl formation by the intensification of the anabolic flux of acetohydroxy acid intermediates", European Brewery Convention: Proceedings of the 21st Congress, pp. 553-560, Madrid, Spain (1987).

Groot, W.J., et al., "Technologies for butanol recovery integrated with fermentations," *Process. Biochem.* 27:61-75, Elsevier Ltd., England (1992).

Guo, W.F., et al., "Pervaporation study on the dehydration of aqueous butanol solutions: a comparison of flux vs. permeance, separation factor vs. selectivity," *J. Membr. Sci.* 245:199-210, Elsevier B.V., Netherlands (2004).

Harashima, S., "Heterologous Protein Production by Yeast Host-Vector Systems," *Bioprocess Technol.* 19:137-158, Marcel Dekker, Inc., New York, United States (1994).

Higgins, D.G. and Sharp, P.M., "Fast and sensitive multiple sequence alignments on a microcomputer," *Comput. Appl. Biosci.* 5:151-153, IRL Press, England (1989).

Higgins, D.G., et al., "CLUSTAL V: improved software for multiple sequence alignment," *Comput. Appl. Biosci.* 8:189-191, IRL Press, England (1992).

Horton, R.M., et al., "Engineering hybrid genes without the use of restriction enzymes: gene splicing by overlap extension," *Gene* 77:61-68, Elsevier Science Publishers B.V., Netherlands (1989).

Imlay, J.A., "Iron—sulphor clusters and the problem with oxygen," *Mol. Microbiol.* 59:1073-1082, Blackwell Scientific Publications, England (2006).

Johnson, D.C., et al., "Structure, Function and Formation of Biological Iron-Sulfur Clusters," *Annu. Rev. Biochem* 74:247-281, Annual Reviews, United States(2005).

Karlin, S., et al., "Comparative analysis of gene expression among low G+C gram-positive genomes," *Proc. Natl. Acad. Sci. USA* 101(16):6182-6187, The National Academy of Sciences of the USA, United States (2004).

Kim, S. and Lee, S.B., "Catalytic promiscuity in dihydroxy-acid dehydratase from the thermoacidophilic archaeon *Sulfolobus solfataricus*", *J Biochem.* 139:591-596, Oxford University Press, England (2006).

Kleerebezem, M., et al., "Controlled Gene Expression Systems for Lactic Acid Bacteria: Transferable Nisin-Inducible Expression Cassettes for *Lactococcus, Leuconostoc*, and *Lactobacillus* spp.," *Appl. Environ. Microbiol.* 63(11):4581-4584, American Society for Microbiology, United States (1997).

Krogh, A., et al., "Hidden Markov models in computational biology: Applications to protein modeling," *J. Mol. Biol.* 235:1501-1531, Academic Press, United States (1994).

Lill, R. and Mühlenhoff, U., "Maturation of iron—sulfur proteins in eukaryotes: mechanisms, connected processes, and diseases," *Annu. Rev. Biochem.* 77:669-700, Annual Reviews, United States (2008).

Loh, E.Y., et al., "Polymerase chain reaction with single-sided specificity: analysis of T cell receptor delta chain," *Science* 243:217-220, American Association for the Advancement of Science, United States (1989).

Maguin, E., et al., "New Thermosensitive Plasmid for Gram-Positive Bacteria," *J. Bacterial.* 174(17):5633-5638, American Society for Microbiology, United States (1992).

Mendoza-Vega, O., et al., "Industrial production of heterologous proteins by fed-batch cultures of the yeast *Saccharomyces cerevisiae*," *FEMS Microbiol. Rev.*15:369-410, Elsevier, England.

Ohara, O., et al., "One-sided polymerase chain reaction: The amplification of cDNA," *Proc. Natl. Acad. Sci. USA* 86:5673-5677, National Academy of Sciences, United States (1989).

O'Sullivan, D.J., et al., "High- and low-copy-number *Lactococcus* shuttle cloning vectors with features for clone screening," *Gene* 137:227-231, Elsevier Science Publishers B.V., Netherlands (1993).

(56) References Cited

OTHER PUBLICATIONS

Polaina, J., "Cloning of the *ILV2, ILV3* and *ILV5* genes of *Saccharomyces cerevisiae*", *Carlsberg Res. Commun.* 49:577-584, Springer-Verlag, Germany (1984).
Renault, P., et al., "Plasmid vectors for gram-positive bacteria switching from high to low copy number," *Gene* 183:175-182, Elsevier Science Publishers B.V., Netherlands (1996).
Roggenkamp, R., et al., "Expression and processing of bacterial β-lactamase in the yeast *Saccharomyces cerevisiae*," *Proc. Natl. Acad. Sci. USA* 78(7):4466-4470, National Academy of Sciences, United States (1981).
Romanos, M.A., et al., "Foreign Gene Expression in Yeast: a Review," *Yeast.* 8:423-488, John Wiley & Sons Ltd, England (1992).
Rud, I., et al., "A synthetic promoted library for constitutive gene expression in *Lactobacillus plantarum*," *Microbiology* 152:1011-1019, SGM, Great Britain (2006).
Rupp, H., et al., "Electron spin relaxation of iron-sulphur proteins studied by microwave power saturation," *Biochimica et Biophysica Acta* 537:255-260, Elsevier Publishing Company, Netherlands (1978).
Russell, C., et al., "Production of Recombinant Products in Yeasts: A Review," *Aust. J Biotechnol.* 5(1):48-55, Australian Industrial Publishers for the Australian Biotechnology Association, Australia (1991).
Ryan, E.D. and Kohlhaw, G.B., "Subcellular Localization of Isoleucine-Valine Biosynthetic Enzymes in Yeast," *J. Bacteriol.* 120(2):631-637, American Society for Microbiology, United States (1974).
Rychlik, W., "Selection of Primers for polymerase chain reaction," *Methods Mol. Biol.* 15:31-40, Humana Press, United States (1993).
Scott, H.N., et al., "Sequences of versatile broad-host-range vectors of the RK2 family," *Plasmid* 50:74-79, Academic Press, United States (2003).
Seffernick, J.L., et al., "Melamine Deaminase and Atrazine Chlorohydrolase: 98 Percent Identical but Functionally Different," *J. Bacteriol.* 183(8):2405-2410, American Society for Microbiology, United States (2001).
Sørvig E., et al., "Plasmid p256 from *Lactobacillus plantarum* represents a new type of replicon in lactic acis bacteria, and contains a toxin-antitoxin-like plasmid maintenance system," *Microbiology*151:421-431, SGM, Great Britain (2005).
Sulter, G.J., et al., "Proliferation and metabolic significance of peroxisomes in *Candida boidinii* during growth on D-alanine or oleic acid as the sole carbon source," *Arch. Microbiol.* 153:485-489, Springer-Verlag, Germany (1990).
Tabor, S. and Richardson, C. C., "A Bacteriophage T7 RNA polymerase/promoter system for contolled exclusive expression of specific genes," *Proc. Natl. Acad. Sci. USA*, 82:1074-1078, National Academy of Sciences, United States (1985).
Tanimoto, K. and Ike, Y., "Analysis of the Conjugal Transfer System of the Pheromone-Independent Highly Transferable *Enterococcus* Plasmid pMG1: Identification of a *tra* Gene (*traA*) Up-Regulated during Conjugation," *J. Bacteriol.* 184(20):5800-5804, American Society for Microbiology, United States (2000).
Thein and Wallace, "The use of oligonucleotides as specific hybridization probes in the diagnosis of genetic disorders," in *Human Genetic Diseases: A Practical Approach*, Davis, K.E., Ed., pp. 33-50, IRL: Herndon, United States (1986).
Thompson, J.D., et al., "CLUSTAL W: improving the sensitivity of progressive multiple sequence alignment through sequence weighting, position-specific gap penalties and weight matrix choice," *Nucleic Acids Res.* 22(22):4678-4680, Oxford University Press, England (1994).
Ui, S., et al., "Production of L-2,3-butanediol by a new pathway constructed in *Escherichia coli*," *Lett. Appl. Microbiol.* 39:533-537, The Society for Applied Microbiology, England (2004).
Van Kranenburg, R., et al., "Functional Analysis of Three Plasmids from *Lactobacillus plantarum*," *Appl. Environ. Microbiol.* 71(3):1223-1230, American Society for Microbiology, United States (2005).
Van Ness, J. and Chen, L., "The use of oligodeoxynucleotide probes in chaotrope-based hybridization solutions," *Nucleic Acids Res.* 19(19):5143-5151, Oxford University Press, England (1991).
Velasco, J. A., et al., "Cloning of the dihydroxyacid dehydratase-encoding gene (*ILV3*) from *Saccharomyces cerevisiae*," *Gene* 137:179-185, Elsevier Science Publishers B.V., Netherlands (1993).
Villa, K.D., et al., "Control of Vicinal Diketone Production by Brewer's Yeast. I. Effects of *ILV5* and *ILV3* Gene Amplification on Vicinal Diketone Production and *ILV* Enzyme Activity", *Journal of the American Society of Brewing Chemists* 53:49-53, American Society of Brewing Chemists, United States (1995).
Walker, G.T., et al., "Isothermal in vitro amplification of DNA by a restriction enzyme/DNA polymerase system," *Proc. Natl. Acad. Sci. USA* 89:392-396, National Academy of Sciences, United States (1992).
Watanabe, S. et al., "Identification and characterization of L-arabonate dehydratase, L-2-keto-3-deoxyarabonate dehydratase, and L-arabinolactonase involved in an alternative pathway of L-arabinose metabolism. Novel evolutionary insight into sugar metabolism," *J. Biol. Chem.* 281(44):33521-33536, Amercican Society for Biochemistry and Molecular Biology, United States (2006).
Witkowski, A., et al., "Comversion of a β-Ketoacyl Synthase to a Malonyl Decarboxylase by Replacement of the Active-Site Cysteine with Glutamine,"*Biochemistry* 38:11643-11650, American Chemical Society, United States (1999).
Wycoff, H.A., et al., "Characterization and Sequence Analysis of a Stable Cryptic Plasmid from *Enterococcus faecium* 226 and Development of a Stable Cloning Vector,"United States (1996).
Zirkle, R., et al., "Analysis of a 108-kb region *Saccharopolyspora spinosa* Genose Covering the Obsucurin Polyketide Synthase Locus," *DNA Seq.* 15(2):123-134, Harwood Academic Publishers, England (2004).
GenBank Accession No. YP_809259.1, dated Aug. 27, 2013.
GenBank Accession No. ADA64951, dated Nov. 21, 2011.
GenBank Accession No. AF508808, dated Jun. 24, 2002.
UniProtKB, Entry Name ILVD_STRMU, Accession No. Q8DRT7, Integrated Date Apr. 4, 2003.
International Search Report and Written Opinion of corresponding International Application No. PCT/US2009/058827, mailed Jan. 4, 2010.
Flint et al., U.S. Appl. No. 13/838,570, filed Mar. 15, 2013.
U.S. Control No. 95/002,167, filed Sep. 10, 2012.
U.S. Control No. 95/002,227, filed Sep. 14, 2012.

|  |  | 56 | 129 | 201 |
|---|---|---|---|---|
| 2Fe-2S | S. mutans DHAD | TPCNIHL | IGGCDKNM | CPGPGGCGGM |
|  | S. solfataricus DHAD | GPCNFHT | IGGCDKTT | HPTLGTCSGL |
|  | A. thaliana(plant) DHAD | NTCNMHL | IPGCDKNM | CPGAGACGGM |
|  | N. europaea DHAD | TPCNMGL | IGGCDKNM | CPGAGSCGGM |
|  | Synechocystis DHAD | TPCNMGI | IGGCDKNM | CPGAGSCGGM |
|  | S. thermophilus DHAD | TPCNIHL | IGGCDKNM | CPGPGGCGGM |
|  | R. metallidurans DHAD | TPCNAGL | IGGCDKNM | CPSTGSCGGM |
|  | R. eutropha DHAD | TPCNAGL | IGGCDKNM | CPSTGSCGGM |
|  | L. lactis DHAD | NPCNMHL | VPGCDKNM | IPGQGACGGM |

| 4Fe-4S | E.coli DHAD | VPGHVHL | ISNCDKIT | CPTCGSCSGM |

FIG. 1

IDENTIFICATION AND USE OF BACTERIAL [2FE-2S] DIHYDROXY-ACID DEHYDRATASES

CROSS-REFERENCE TO RELATED APPLICATIONS

This application is a continuation of U.S. application Ser. No. 12/569,636, filed Sep. 29, 2009, and is related to and claims the benefit of priority of U.S. Provisional Application No. 61/100,792, filed Sep. 29, 2008, the entirety of each of which is herein incorporated by reference.

FIELD OF THE INVENTION

The invention relates to the field of industrial microbiology and the expression of dihydroxy-acid dehydratase activity. More specifically, bacterial dihydroxy-acid dehydratases with a [2Fe-2S] cluster are identified and expressed as heterologous proteins in bacterial and yeast hosts.

BACKGROUND OF THE INVENTION

Dihydroxy-acid dehydratase (DHAD), also called acetohydroxy acid dehydratase, catalyzes the conversion of 2,3-dihydroxyisovalerate to α-ketoisovalerate and of 2,3-dihydroxymethylvalerate to α-ketomethylvalerate. The DHAD enzyme, classified as E.C. 4.2.1.9, is part of naturally occurring biosynthetic pathways producing valine, isoleucine, leucine and pantothenic acid (vitamin B5). Increased expression of DHAD activity is desired for enhanced microbial production of branched chain amino acids or of pantothenic acid.

DHAD catalyzed conversion of 2,3-dihydroxyisovalerate to α-ketoisovalerate is also a common step in the multiple isobutanol biosynthetic pathways that are disclosed in commonly owned and co-pending US Patent Application Publication US 20070092957 A1. Disclosed therein is engineering of recombinant microorganisms for production of isobutanol. Isobutanol is useful as a fuel additive, whose availability may reduce the demand for petrochemical fuels.

For improved production of compounds synthesized in pathways including dihydroxy-acid dehydratase, it is desirable to express a heterologous enzyme that provides this enzymatic activity in the production host of interest. Obtaining high functional expression of dihydroxy-acid dehydratases in a heterologous host is complicated by the enzyme's requirement for an Fe—S cluster, which involves availability and proper loading of the cluster into the DHAD apo-protein.

Fe—S cluster requiring DHAD enzymes are known in the art and are found either in the [4Fe-4S] or [2Fe-2S] form. Some bacterial enzymes are known, the best characterized of which is from E. coli (Flint, D H, et al. (1993) J. Biol. Chem. 268:14732-14742). However these bacterial enzymes are all in the [4Fe-4S] form. The only [2Fe-2S] form reported to date is a spinach enzyme (Flint and Emptage (1988) J. Biol. Chem. 263:3558-3564).

It is desirable to use the [2Fe-2S] form of the enzyme in host cells to enhance the production of introduced biosynthetic pathways as the [2Fe-2S] form creates a lesser burden on Fe—S cluster synthesis and/or assembly. Unfortunately, only one [2Fe-2S] form of this enzyme is known.

There exists a need therefore to identify new [2Fe-2S] forms of DHAD for use in recombinant host cells where the conversion of 2,3-dihydroxyisovalerate to α-ketoisovalerate is a metabolic pathway step in a desired biosynthetic pathway.

SUMMARY OF THE INVENTION

Provided herein is a method for identifying [2Fe-2S] DHAD enzymes, said method comprising:

a) querying one or more amino acid sequences with a Profile Hidden Markov Model prepared using the proteins of SEQ ID NOs:164, 168, 230, 232, 298, 310, 344, and 346, wherein a match with an E-value of less than $10^{-5}$ provides a first subset of sequences whereby said first subset of sequences correspond to one or more DHAD related proteins;

b) analyzing the first subset of sequences that correspond to one or more DHAD related proteins of step (a) for the presence of three conserved cysteines that correspond to positions 56, 129, and 201 in the Streptococcus mutans dihydroxy-acid dehydratase amino acid sequence (SEQ ID NO: 168) whereby a second subset of sequences encoding [2Fe-2S] DHAD enzymes are identified; and c) analyzing said second subset of sequences of step (b) for the presence of signature conserved amino acids at positions corresponding to positions in the Streptococcus mutans DHAD amino acid sequence (SEQ ID NO: 168) that are aspartic acid at position 88, arginine or asparagine at position 142, asparagine at position 208, and leucine at position 454 whereby a third subset of sequences encoding [2Fe-2S] DHAD enzymes are further identified.

In another aspect of the invention, the above method further comprises:

d) expressing a polypeptide having a sequence identifiable by any one or all of steps a), b), and c) in a cell; and e) confirming that said polypeptide has DHAD activity in the cell.

In another aspect of the invention, the method above further comprises:

d) purifying a protein encoded by a sequence identifiable by any one or all of steps a), b), and c); and e) confirming that said protein is a [2Fe-2S] DHAD enzyme by UV-vis and EPR spectroscopy.

In another aspect of the invention, the method above further comprises selecting one or more sequences corresponding to bacterial [2Fe-2S] DHAD enzyme sequences identified in any one or all of steps a), b), and c). Said selected sequences may be expressed in a cell; and the DHAD activity in the cell may be confirmed. Said selected sequences may be further purified such that a purified protein is obtained and the [2Fe-2S] DHAD enzyme activity of said purified protein may be confirmed by UV-vis and EPR spectroscopy.

Another aspect of the invention is directed to a microbial host cell comprising at least one heterologous [2Fe-2S] DHAD enzyme identifiable by the methods described herein. Said cell may be a bacterial cell or a yeast cell. The cell may also be a recombinant cell that produces isobutanol.

Another aspect of the invention is a method for the production of isobutanol comprising:

a) providing the microbial host cell comprising at least one heterologous [2Fe-2S] DHAD enzyme identifiable by the methods described herein wherein said host cell further comprises an isobutanol biosynthetic pathway; and b) growing the host cell of step (a) under conditions wherein isobutanol is produced.

Another aspect of the invention is a method for the conversion of 2,3-dihydroxyisovalerate to α-ketoisovalerate comprising:

a) providing a microbial host cell comprising at least one heterologous [2Fe-2S] DHAD enzyme identifiable by the methods described herein and a source of 2,3-dihydroxyisovalerate; and b) growing the microbial host cell of (a) under conditions where the 2,3-dihydroxyisovalerate is converted to α-ketoisovalerate.

BRIEF DESCRIPTION OF THE FIGURES AND SEQUENCE DESCRIPTIONS

The invention can be more fully understood from the following detailed description, figure, and the accompanying sequence descriptions, which form a part of this application.

FIG. 1 shows the conserved cysteine regions, with C for cysteine in bold, representative bacterial [2Fe-2S] DHADs and a [4Fe-4S] DHAD. Single letter amino acid abbreviations are used. (Regions depicted from left to right for *S. mutans* DHAD: SEQ ID NOs: 619, 620, and 621; for *S. solfataricus* DHAD: SEQ ID NOs: 622, 623, and 624; for *A. thaliana* DHAD: SEQ ID NOs: 625, 626, and 627; for *N. europaea* DHAD: SEQ ID NOs: 628, 620, and 629; for *Synechocystis* DHAD: 630, 620, and 629; for *S. thermophilus* DHAD: SEQ ID NOs: 619, 620, and 621; for *R. metallidurans* DHAD: 622, 620, and 631; for *R. eutropha* DHAD: 622, 620, and 631; for *L. lactis* DHAD: 632, 633, and 634; for *E. coli* DHAD: 635, 636, and 637.)

FIG. 2 shows a phylogenetic tree of DHAD related proteins. Branches for [4Fe-4S] and [2Fe-2S] DHADs as well as EDDs, aldonic acid dehydratases and an undefined group (Und) are marked. Select individual DHADs are labeled.

Figure 2:
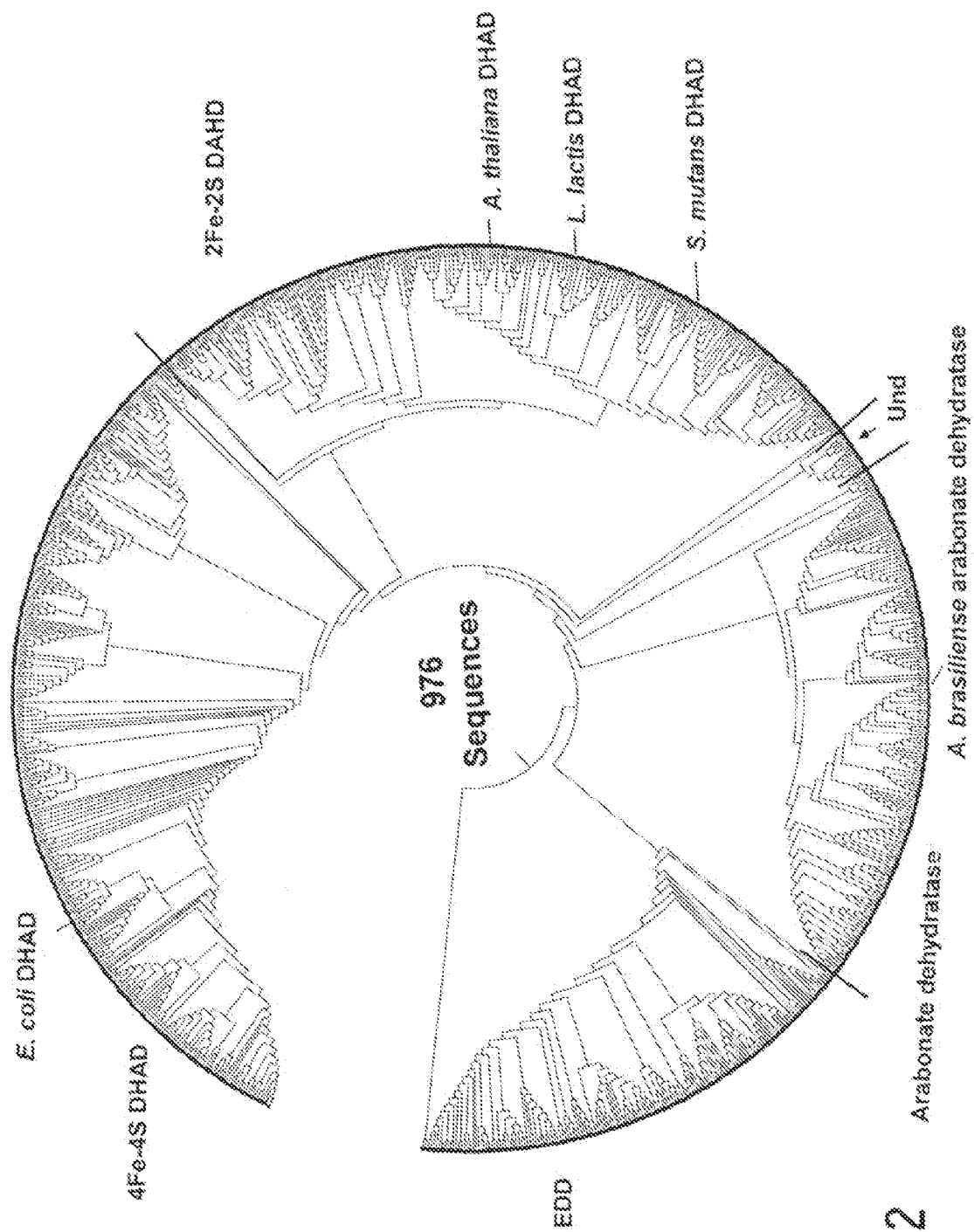

Table 1 is a table of the Profile HMM for dihydroxy-acid dehydratases based on enzymes with assayed function prepared as described in Example 1. Table 1 is submitted herewith electronically and is incorporated herein by reference.

The following sequences conform with 37 C.F.R. 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5 (a-bis), and Section 208 and Annex C of the Administrative Instructions). The symbols and format used for nucleotide and amino acid sequence data comply with the rules set forth in 37 C.F.R. §1.822.

TABLE 2a

Representative bacterial [2Fe—2S] DHAD proteins and encoding sequences

| Organism of derivation | SEQ ID NO: Nucleic acid | SEQ ID NO: Peptide |
|---|---|---|
| *Mycobacterium* sp. MCS | 1 | 2 |
| *Mycobacterium gilvum* PYR-GCK | 3 | 4 |
| *Mycobacterium smegmatis* str. MC2 155 | 5 | 6 |
| *Mycobacterium vanbaalenii* PYR-1 | 7 | 8 |
| *Nocardia farcinica* IFM 10152 | 9 | 10 |
| *Rhodococcus* sp. RHA1 | 11 | 12 |
| *Mycobacterium ulcerans* Agy99 | 13 | 14 |

TABLE 2a-continued

Representative bacterial [2Fe—2S] DHAD proteins and encoding sequences

| Organism of derivation | SEQ ID NO: Nucleic acid | SEQ ID NO: Peptide |
|---|---|---|
| *Mycobacterium avium* subsp. *paratuberculosis* K-10 | 15 | 16 |
| *Mycobacterium tuberculosis* H37Ra | 17 | 18 |
| *Mycobacterium leprae* TN * | 19 | 20 |
| *Kineococcus radiotolerans* SRS30216 | 21 | 22 |
| *Janibacter* sp. HTCC2649 | 23 | 24 |
| *Nocardioides* sp. JS614 | 25 | 26 |
| *Renibacterium salmoninarum* ATCC 33209 | 27 | 28 |
| *Arthrobacter aurescens* TC1 | 29 | 30 |
| *Leifsonia xyli* subsp. *xyli* str. CTCB07 | 31 | 32 |
| *Marine actinobacterium* PHSC20C1 | 33 | 34 |
| *Clavibacter michiganensis* subsp. *michiganensis* NCPPB 382 | 35 | 36 |
| *Saccharopolyspora erythraea* NRRL 2338 | 37 | 38 |
| *Acidothermus cellulolyticus* 11B | 39 | 40 |
| *Corynebacterium efficiens* YS-314 | 41 | 42 |
| *Brevibacterium linens* BL2 | 43 | 44 |
| *Tropheryma whipplei* TW08/27 | 45 | 46 |
| *Methylobacterium extorquens* PA1 | 47 | 48 |
| *Methylobacterium chloromethanicum* | 428 | 429 |
| *Methylobacterium nodulans* ORS 2060 | 49 | 50 |
| *Rhodopseudomonas palustris* BisB5 | 51 | 52 |
| *Rhodopseudomonas palustris* BisB18 | 53 | 54 |
| *Bradyrhizobium* sp. ORS278 | 55 | 56 |
| *Bradyrhizobium japonicum* USDA 110 | 57 | 58 |
| *Fulvimarina pelagi* HTCC2506 | 59 | 60 |
| *Aurantimonas* sp. SI85-9A1 | 61 | 62 |
| *Hoeflea phototrophica* DFL-43 | 63 | 64 |
| *Mesorhizobium loti* MAFF303099 | 65 | 66 |
| *Mesorhizobium* sp. BNC1 | 67 | 68 |
| *Parvibaculum lavamentivorans* DS-1 | 69 | 70 |
| *Loktanella vestfoldensis* SKA53 | 71 | 72 |
| *Roseobacter* sp. CCS2 | 73 | 74 |
| *Dinoroseobacter shibae* DFL 12 | 75 | 76 |
| *Roseovarius nubinhibens* ISM | 77 | 78 |
| *Sagittula stellata* E-37 | 79 | 80 |
| *Roseobacter* sp. AzwK-3b | 81 | 82 |
| *Roseovarius* sp. TM1035 | 83 | 84 |
| *Oceanicola batsensis* HTCC2597 | 85 | 86 |
| *Oceanicola granulosus* HTCC2516 | 87 | 88 |
| *Rhodobacterales bacterium* HTCC2150 | 89 | 90 |
| *Paracoccus denitrificans* PD1222 | 91 | 92 |
| *Oceanibulbus indolifex* HEL-45 | 93 | 94 |
| *Sulfitobacter* sp. EE-36 | 95 | 96 |
| *Roseobacter denitrificans* OCh 114 | 97 | 98 |
| *Jannaschia* sp. CCS1 | 99 | 100 |
| *Caulobacter* sp. K31 | 101 | 102 |
| *Candidatus Pelagibacter ubique* HTCC1062 | 103 | 104 |
| *Erythrobacter litoralis* HTCC2594 | 105 | 106 |
| *Erythrobacter* sp. NAP1 | 107 | 108 |
| *Comamonas testosterone* KF-1 | 109 | 110 |
| *Sphingomonas wittichii* RW1 | 111 | 112 |
| *Burkholderia xenovorans* LB400 | 113 | 114 |
| *Burkholderia phytofirmans* PsJN | 115 | 116 |
| *Bordetella petrii* DSM 12804 | 117 | 118 |
| *Bordetella bronchiseptica* RB50 | 119 | 120 |
| *Bradyrhizobium* sp. ORS278 | 121 | 122 |
| *Bradyrhizobium* sp. BTAi1 | 123 | 124 |
| *Bradhyrhizobium japonicum* | 125 | 126 |
| *Sphingomonas wittichii* RW1 | 127 | 128 |
| *Rhodobacterales bacterium* HTCC2654 | 129 | 130 |
| *Solibacter usitatus* Ellin6076 | 131 | 132 |
| *Roseiflexus* sp. RS-1 | 133 | 134 |
| *Rubrobacter xylanophilus* DSM 9941 | 135 | 136 |
| *Salinispora tropica* CNB-440 | 137 | 138 |
| *Acidobacteria bacterium* Ellin345 | 139 | 140 |
| *Thermus thermophilus* HB27 | 141 | 142 |
| *Maricaulis maris* MCS10 | 143 | 144 |
| *Parvularcula bermudensis* HTCC2503 | 145 | 146 |
| *Oceanicaulis alexandrii* HTCC2633 | 147 | 148 |
| *Plesiocystis pacifica* SIR-1 | 149 | 150 |

TABLE 2a-continued

Representative bacterial [2Fe—2S] DHAD proteins and encoding sequences

| Organism of derivation | SEQ ID NO: Nucleic acid | SEQ ID NO: Peptide |
|---|---|---|
| Bacillus sp. NRRL B-14911 | 151 | 152 |
| Oceanobacillus iheyensis HTE831 | 153 | 154 |
| Staphylococcus saprophyticus subsp. saprophyticus ATCC 15305 | 155 | 156 |
| Bacillus selenitireducens MLS10 | 157 | 158 |
| Streptococcus pneumoniae SP6-BS73 | 159 | 160 |
| Streptococcus sanguinis SK36 | 161 | 162 |
| Streptococcus thermophilus LMG 18311 | 163 | 164 |
| Streptococcus suis 89/1591 | 165 | 166 |
| Streptococcus mutans UA159 | 167 | 168 |
| Leptospira borgpetersenii serovar Hardjo-bovis L550 | 169 | 170 |
| Candidatus Vesicomyosocius okutanii HA | 171 | 172 |
| Candidatus Ruthia magnifica str. Cm (Calyptogena magnifica) | 173 | 174 |
| Methylococcus capsulatus str. Bath | 175 | 176 |
| uncultured marine bacterium EB80_02D08 | 177 | 178 |
| uncultured marine gamma proteobacterium EBAC31A08 | 179 | 180 |
| uncultured marine gamma proteobacterium EBAC20E09 | 181 | 182 |
| uncultured gamma proteobacterium eBACHOT4E07 | 183 | 184 |
| Alcanivorax borkumensis SK2 | 185 | 186 |
| Chromohalobacter salexigens DSM 3043 | 187 | 188 |
| Marinobacter algicola DG893 | 189 | 190 |
| Marinobacter aquaeolei VT8 | 191 | 192 |
| Marinobacter sp. ELB17 | 193 | 194 |
| Pseudoalteromonas haloplanktis TAC125 | 195 | 196 |
| Acinetobacter sp. ADP1 | 197 | 198 |
| Opitutaceae bacterium TAV2 | 199 | 200 |
| Flavobacterium sp. MED217 | 201 | 202 |
| Cellulophaga sp. MED134 | 203 | 204 |
| Kordia aigicida OT-1 | 205 | 206 |
| Flavobacteriales bacterium ALC-1 | 207 | 208 |
| Psychroflexus torquis ATCC 700755 | 209 | 210 |
| Flavobacteriales bacterium HTCC2170 | 211 | 212 |
| unidentified eubacterium SCB49 | 213 | 214 |
| Gramella forsetii KT0803 | 215 | 216 |
| Robiginitalea biformata HTCC2501 | 217 | 218 |
| Tenacibaculum sp. MED152 | 219 | 220 |
| Polaribacter irgensii 23-P | 221 | 222 |
| Pedobacter sp. BAL39 | 223 | 224 |
| Flavobacteria bacterium BAL38 | 225 | 226 |
| Flavobacterium psychrophilum JIP02/86 | 227 | 228 |
| Flavobacterium johnsoniae UW101 | 229 | 230 |
| Lactococcus lactis subsp. cremoris SK11 | 231 | 232 |
| Psychromonas ingrahamii 37 | 233 | 234 |
| Microscilla marina ATCC 23134 | 235 | 236 |
| Cytophaga hutchinsonii ATCC 33406 | 237 | 238 |
| Rhodopirellula baltica SH 1 | 239 | 240 |
| Blastopirellula marina DSM 3645 | 241 | 242 |
| Planctomyces maris DSM 8797 | 243 | 244 |
| Algoriphagus sp. PR1 | 245 | 246 |
| Candidatus Sulcia muelleri str. Hc (Homalodisca coagulata) | 247 | 248 |
| Candidatus Carsonella ruddii PV | 249 | 250 |
| Synechococcus sp. RS9916 | 251 | 252 |
| Synechococcus sp. WH 7803 | 253 | 254 |
| Synechococcus sp. CC9311 | 255 | 256 |
| Synechococcus sp. CC9605 | 257 | 258 |
| Synechococcus sp. WH 8102 | 259 | 260 |
| Synechococcus sp. BL107 | 261 | 262 |
| Synechococcus sp. RCC307 | 263 | 264 |
| Synechococcus sp. RS9917 | 265 | 266 |
| Synechococcus sp. WH 5701 | 267 | 268 |
| Prochlorococcus marinus str. MIT 9313 | 269 | 270 |
| Prochlorococcus marinus str. NATL2A | 271 | 272 |
| Prochlorococcus marinus str. MIT 9215 | 273 | 274 |
| Prochlorococcus marinus str. AS9601 | 275 | 276 |
| Prochlorococcus marinus str. MIT 9515 | 277 | 278 |

TABLE 2a-continued

Representative bacterial [2Fe—2S] DHAD proteins and encoding sequences

| Organism of derivation | SEQ ID NO: Nucleic acid | SEQ ID NO: Peptide |
|---|---|---|
| Prochlorococcus marinus subsp. pastoris str. CCMP1986 | 279 | 280 |
| Prochlorococcus marinus str. MIT 9211 | 281 | 282 |
| Prochlorococcus marinus subsp. marinus str. CCMP1375 | 283 | 284 |
| Nodulana spumigena CCY9414 | 285 | 286 |
| Nostoc punctiforme PCC 73102 | 287 | 288 |
| Nostoc sp. PCC 7120 | 289 | 290 |
| Trichodesmium erythraeum IMS101 | 291 | 292 |
| Acaryochloris marina MBIC11017 | 293 | 294 |
| Lyngbya sp. PCC 8106 | 295 | 296 |
| Synechocystis sp. PCC 6803 | 297 | 298 |
| Microcystis aeruginosa PCC 7806 | 426 | 427 |
| Cyanothece sp. CCY0110 | 299 | 300 |
| Thermosynechococcus elongatus BP-1 | 301 | 302 |
| Synechococcus sp. JA-2-3B'a(2-13) | 303 | 304 |
| Gloeobacter violaceus PCC 7421 | 305 | 306 |
| Nitrosomonas eutropha C91 | 307 | 308 |
| Nitrosomonas europaea ATCC 19718 | 309 | 310 |
| Nitrosospira multiformis ATCC 25196 | 311 | 312 |
| Chloroflexus aggregans DSM 9485 | 313 | 314 |
| Leptospirillum sp. Group II UBA | 315 | 316 |
| Leptospirillum sp. Group II UBA | 317 | 318 |
| Halorhodospira halophila SL1 | 319 | 320 |
| Nitrococcus mobilis Nb-231 | 321 | 322 |
| Alkalilimnicola ehrlichei MLHE-1 | 323 | 324 |
| Deinococcus geothermalis DSM 11300 | 325 | 326 |
| Polynucleobacter sp. QLW-P1DMWA-1 | 327 | 328 |
| Polynucleobacter necessarius STIR1 | 329 | 330 |
| Azoarcus sp. EbN1 | 331 | 332 |
| Burkholderia phymatum STM815 | 333 | 334 |
| Burkholderia xenovorans LB400 | 335 | 336 |
| Burkholderia multivorans ATCC 17616 | 337 | 338 |
| Burkholderia cenocepacia PC184 | 339 | 340 |
| Burkholderia mallei GB8 horse 4 | 341 | 342 |
| Ralstonia eutropha JMP134 | 343 | 344 |
| Ralstonia metallidurans CH34 | 345 | 346 |
| Ralstonia solanacearum UW551 | 347 | 348 |
| Ralstonia pickettii 12J | 349 | 350 |
| Limnobacter sp. MED105 | 351 | 352 |
| Herminiimonas arsenicoxydans | 353 | 354 |
| Bordetella parapertussis | 355 | 356 |
| Bordetella petrii DSM 12804 | 357 | 358 |
| Polaromonas sp. JS666 | 359 | 360 |
| Polaromonas naphthalenivorans CJ2 | 361 | 362 |
| Rhodoferax ferrireducens T118 | 363 | 364 |
| Verminephrobacter eiseniae EF01-2 | 365 | 366 |
| Acidovorax sp. JS42 | 367 | 368 |
| Delftia acidovorans SPH-1 | 369 | 370 |
| Methylibium petroleiphilum PM1 | 371 | 372 |
| gamma proteobacterium KT 71 | 373 | 374 |
| Tremblaya princeps | 375 | 376 |
| Blastopirellula marina DSM 3645 | 377 | 378 |
| Planctomyces maris DSM 8797 | 379 | 380 |
| Salinibacter ruber DSM 13855 | 387 | 388 |

TABLE 2b

Additional representative bacterial [2Fe—2S] DHAD proteins and encoding sequences

| Organism of derivation | Nucleic acid SEQ ID NO: | Amino acid SEQ ID NO: |
|---|---|---|
| Burkholderia ambifaria AMMD | 443 | 444 |
| Bradyrhizobium sp. BTAi1 | 445 | 446 |
| Delftia acidovorans SPH-1 | 447 | 448 |

TABLE 2b-continued

Additional representative bacterial [2Fe—2S] DHAD proteins and encoding sequences

| Organism of derivation | Nucleic acid SEQ ID NO: | Amino acid SEQ ID NO: |
|---|---|---|
| Microcystis aeruginosa NIES-843 | 449 | 450 |
| uncultured marine microorganism HF4000_APKG8C21 | 451 | 452 |
| Burkholderia ubonensis Bu | 453 | 454 |
| Gemmata obscuriglobus UQM 2246 | 455 | 456 |
| Mycobacterium abscessus | 457 | 458 |
| Synechococcus sp. PCC 7002 | 459 | 460 |
| Burkholderia graminis C4D1M | 461 | 462 |
| Methylobacterium radiotolerans JCM 2831 | 463 | 464 |
| Leptothrix cholodnii SP-6 | 465 | 466 |
| Verrucomicrobium spinosum DSM 4136 | 467 | 468 |
| Cyanothece sp. ATCC 51142 | 469 | 470 |
| Opitutus terrae PB90-1 | 471 | 472 |
| Leptospira biflexa serovar Patoc strain 'Patoc 1 (Paris)' | 473 | 474 |
| Methylacidiphilum infernorum V4 | 475 | 476 |
| Cupriavidus taiwanensis | 477 | 478 |
| Chthoniobacter flavus Ellin428 | 479 | 480 |
| Cyanothece sp. PCC 7822 | 481 | 482 |
| Phenylobacterium zucineum HLK1 | 483 | 484 |
| Leptospirillum sp. Group II '5-way CG' | 485 | 486 |
| Arthrospira maxima CS-328 | 487 | 488 |
| Oligotropha carboxidovorans OM5 | 489 | 490 |
| Rhodospirillum centenum SW | 491 | 492 |
| Cyanothece sp. PCC 8801 | 493 | 494 |
| Thermus aquaticus Y51MC23 | 495 | 496 |
| Cyanothece sp. PCC 7424 | 497 | 498 |
| Acidithiobacillus ferrooxidans ATCC 23270 | 499 | 500 |
| Cyanothece sp. PCC 7425 | 501 | 502 |
| Arthrobacter chlorophenolicus A6 | 503 | 504 |
| Burkholderia multivorans CGD2M | 505 | 506 |
| Thermomicrobium roseum DSM 5159 | 507 | 508 |
| bacterium Ellin514 | 509 | 510 |
| Desulfobacterium autotrophicum HRM2 | 511 | 512 |
| Thioalkalivibrio sp. K90mix | 513 | 514 |
| Flavobacteria bacterium MS024-3C | 515 | 516 |
| Flavobacteria bacterium MS024-2A | 517 | 518 |
| 'Nostoc azollae' 0708 | 519 | 520 |
| Acidobacterium capsulatum ATCC 51196 | 521 | 522 |
| Gemmatimonas aurantiaca T-27 | 523 | 524 |
| Gemmatimonas aurantiaca T-27 | 525 | 526 |
| Rhodococcus erythropolis PR4 | 527 | 528 |
| Deinococcus deserti VCD115 | 529 | 530 |
| Rhodococcus opacus B4 | 531 | 532 |
| Chryseobacterium gleum ATCC 35910 | 533 | 534 |
| Thermobaculum terrenum ATCC BAA-798 | 535 | 536 |
| Kribbella flavida DSM 17836 | 537 | 538 |
| Gordonia bronchialis DSM 43247 | 539 | 540 |
| Geodermatophilus obscurus DSM 43160 | 541 | 542 |
| Xylanimonas cellulosilytica DSM 15894 | 543 | 544 |
| Sphingobacterium spiritivorum ATCC 33300 | 545 | 546 |
| Meiothermus silvanus DSM 9946 | 547 | 548 |
| Meiothermus ruber DSM 1279 | 549 | 550 |
| Nakamuralla multipartita DSM 44233 | 551 | 552 |
| Cellulomonas flavigena DSM 20109 | 553 | 554 |
| Rhodothermus marinus DSM 4252 | 555 | 556 |
| Planctomyces limnophilus DSM 3776 | 557 | 558 |
| Beutenbergia cavernae DSM 12333 | 559 | 560 |
| Spirosoma linguale DSM 74 | 561 | 562 |
| Sphaerobacter thermophilus DSM 20745 | 563 | 564 |
| Lactococcus lactis | 565 | 566 |
| Thermus thermophilus HB8 | 567 | 568 |
| Anabaena variabilis ATCC 29413 | 569 | 570 |
| Roseovarius sp. 217 | 571 | 572 |
| uncultured Prochlorococcus marinus clone HF10-88D1 | 573 | 574 |
| Burkholderia xenovorans LB400 | 575 | 576 |
| Saccharomonospora viridis DSM 43017 | 577 | 578 |
| Pedobacter heparinus DSM 2366 | 579 | 580 |
| Microcoleus chthonoplastes PCC 7420 | 581 | 582 |
| Acidimicrobium ferrooxidans DSM 10331 | 583 | 584 |
| Rhodobacterales bacterium HTCC2083 | 585 | 586 |
| Candidatus Pelagibacter sp. HTCC7211 | 587 | 588 |
| Chitinophaga pinensis DSM 2588 | 589 | 590 |
| Alcanivorax sp. DG881 | 591 | 592 |
| Micrococcus luteus NCTC 2665 | 593 | 594 |
| Verrucomicrobiae bacterium DG1235 | 595 | 596 |
| Synechococcus sp. PCC 7335 | 597 | 598 |
| Brevundimonas sp. BAL3 | 599 | 600 |
| Dyadobacter fermentans DSM 18053 | 601 | 602 |
| gamma proteobacterium NOR5-3 | 603 | 604 |
| gamma proteobacterium NOR51-B | 605 | 606 |
| Cyanobium sp. PCC 7001 | 607 | 608 |
| Jonesia denitrificans DSM 20603 | 609 | 610 |
| Brachybacterium faecium DSM 4810 | 611 | 612 |
| Paenibacillus sp. JDR-2 | 613 | 614 |
| Octadecabacter antarcticus 307 | 615 | 616 |
| Variovorax paradoxus S110 | 617 | 618 |

TABLE 3

SEQ ID Numbers of Additional Proteins and Encoding sequences

| Description | SEQ ID NO: Encoding seq | SEQ ID NO: protein |
|---|---|---|
| Vibrio cholerae KARI | 389 | 390 |
| Pseudomonas aeruginosa PAO1 KARI | 422 | 423 |
| Pseudomonas fluorescens PF5 KARI | 391 | 392 |
| Achromobacter xylosoxidans butanol dehydrogenase sadB | 393 | 394 |
| Escherichia coli str. K-12 substr. MG1655 Phosphogluconate dehydratase | 383 | 384 |
| Azospirillum brasilense arabonate dehydratase | 385 | 386 |
| Escherichia coli str. K-12 substr. MG1655 DHAD | 381 | 382 |

SEQ ID NOs:395-409, 412-421, 424, and 431-436 are primers for PCR, cloning or sequencing analysis used a described in the Examples herein.

SEQ ID NO:410 is the nucleotide sequence of the pDM1 vector.

SEQ ID NO:411 is the nucleotide sequence of the pLH532 vector.

SEQ ID NO:425 is the S. cerevisiae FBA promoter.

SEQ ID NO:430 is the nucleotide sequence of the pRS423 FBA ilvD(Strep) vector.

SEQ ID NO:437 is the nucleotide sequence of the pNY13 vector

SEQ ID NO:438 is the alsS coding region from B. subtilis.

SEQ ID NO:439 is the S. cerevisiae GPD promoter.

SEQ ID NO:440 is the S. cerevisiae CYC1 terminator.

SEQ ID NO:442 is the S. cerevisiae ILV5 gene.

DETAILED DESCRIPTION OF THE INVENTION

As disclosed herein, applicants have solved the stated problem through the discovery of methods of identifying [2Fe-2S] DHADs. Through the discovery these enzymes and their use in recombinant hosts, a heretofore unappreciated activity advantage in pathway engineering with DHADs has been identified.

The present invention relates to recombinant yeast or bacterial cells engineered to provide heterologous expression of dihydroxy-acid dehydratase (DHAD) having a [2Fe-2S] cluster. The expressed DHAD functions as a component of a biosynthetic pathway for production of a compound such as valine, isoleucine, leucine, pantothenic acid, or isobutanol. These amino acids and pantothenic acid may be used as nutritional supplements, and isobutanol may be used as a fuel additive to reduce demand for petrochemicals.

The following abbreviations and definitions will be used for the interpretation of the specification and the claims.

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value The term "[2Fe-2S] DHAD" refers to DHAD enzymes having a bound [2Fe-2S] cluster.

The term "[4Fe-4S] DHAD" refers to DHAD enzymes having a bound [4Fe-4S] cluster.

There term "Dihydroxy-acid dehydratase" will be abbreviated DHAD and will refer to an enzyme that converts 2,3-dihydroxyisovalerate to α-ketoisovalerate.

The term "isobutanol biosynthetic pathway" refers to an enzyme pathway to produce isobutanol from pyruvate.

The term "a facultative anaerobe" refers to a microorganism that can grow in both aerobic and anaerobic environments.

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof. Carbon substrates may include C6 and C5 sugars and mixtures thereof.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

As used herein the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression may also refer to translation of mRNA into a polypeptide.

As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein the term "codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA.

As used herein, an "isolated nucleic acid fragment" or "isolated nucleic acid molecule" will be used interchangeably and will mean a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, $2^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1× SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity", as known in the art, is a relationship between two or more polypeptide sequences or two or more polynucleotide sequences, as determined by comparing the sequences. In the art, "identity" or "sequence identity" also means the degree of sequence relatedness between polypeptide or polynucleotide sequences, as the case may be, as determined by the match between strings of such sequences. "Identity" and "similarity" can be readily calculated by known methods, including but not limited to those described in:

1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS*. 5:151-153 (1989); Higgins, D. G. et al., *Comput. Appl. Biosci.*, 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS*. 5:151-153 (1989); Higgins, D. G. et al., *Comput. Appl. Biosci.* 8:189-191 (1992) Thompson, J. D., Higgins, D. G., and Gibson T. J. (1994) *Nuc. Acid Res.* 22: 4673 4680) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity. Useful examples of percent identities include, but are not limited to: 55%, 60%, 65%, 70%, 75%, 80%, 85%, 90%, or 95%, or any integer percentage from 55% to 100% may be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.*, 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.*, [Proc. Int. Symp.](1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.).

Discovery of [2Fe-2S] DHADs

DHAD proteins are known to contain a bound iron-sulfur (Fe—S) cluster that is required for enzyme activity. The only DHAD with a [2Fe-2S] cluster reported to date is a spinach enzyme (Flint and Emptage (1988) *J. Biol. Chem.* 263:3558-3564). Some bacterial enzymes are also known, the best characterized of which is from *E. coli* (Flint, D H, et al. (1993) *J. Biol. Chem.* 268:14732-14742), which has a [4Fe-4S] cluster.

Applicants have now determined that there is a class of bacterial DHADs that contain a [2Fe-2S] cluster ([2Fe-2S] DHADs). Applicants have found that the group of [2Fe-2S] DHADs may be distinguished from a group of [4Fe-4S] DHADs by the presence of three conserved cysteine residues in the protein. The three conserved cysteines are similar to three essential cysteines reported in the *Azospirillum brasiliense* arabonate (an aldonic acid) dehydratase (Watanabe, S et al. *J. Biol. Chem.* (2006) 281:33521-33536) that was reported to contain a [4Fe-4S] cluster. In the *Azospirillum brasiliense* arabonate dehydratase protein, cysteines located at amino acid positions 56, 124, and 197 were determined to be essential for enzyme activity and likely involved in coordination with the Fe—S cluster. Surprisingly, applicants have found that three conserved cysteines, which are in corresponding positions to the three essential cysteines of the *Azospirillum brasiliense* arabonate dehydratase, are characteristic of DHADs containing a [2Fe-2S] cluster. Applicants have found that the *E. coli* DHAD, that contains a [4Fe-4S] cluster, has two of the conserved cysteines, but not the third conserved cysteine. Shown in FIG. 1 is a comparison of the sequence regions of the conserved cysteines for the *E. coli* [4Fe-4S] cluster-containing DHADs and for representatives of a phylogenetic group of [2Fe-2S] cluster DHADs that was identified herein in Example 1 and is described below.

Applicants have developed a method for identifying [2Fe-2S] DHADs. In the present invention, bacterial [2Fe-2S] DHADs, which may be identified by this method, may be used for heterologous expression in bacteria.

To structurally characterize DHAD enzymes a Profile Hidden Markov Model (HMM) was prepared as described in Example 1 using amino acid sequences of DHAD proteins with experimentally verified function, as determined in Example 2 herein, and is given in Table 1. These DHADs are from *Nitrosomonas europaea* (DNA SEQ ID NO:309; Protein SEQ ID NO:310), *Synechocystis* sp. PCC6803 (DNA SEQ ID:297; Protein SEQ ID NO:298), *Streptococcus mutans* (DNA SEQ ID NO:167; Protein SEQ ID NO:168), *Streptococcus thermophilus* (DNA SEQ ID NO:163; SEQ ID No:164), *Ralstonia metallidurans* (DNA SEQ ID NO:345; Protein SEQ ID NO:346), *Ralstonia eutropha* (DNA SEQ ID NO:343; Protein SEQ ID NO:344), and *Lactococcus lactis* (DNA SEQ ID NO:231; Protein SEQ ID NO:232). In addition the DHAD from *Flavobacterium johnsoniae* (DNA SEQ ID NO:229; Protein SEQ ID NO:230) was found to have dihydroxy-acid dehydratase activity when expressed in *E. coli* and was used in making the Profile. This Profile HMM for DHADs may be used to identify DHAD related proteins. Any protein that matches the Profile HMM with an E value of <$10^{-5}$ is a DHAD related protein, which includes [4Fe-4S] DHADs, [2Fe-2S] DHADs, aldonic acid dehydratases, and phosphogluconate dehydratases. A phylogenetic tree of sequences matching this Profile HMM is shown in FIG. 2.

Sequences matching the Profile HMM given herein are then analyzed for the presence of the three conserved cysteines described above. The exact positions of the three conserved cysteines may vary, and these may be identified in the context of the surrounding sequence using multiple sequence alignments performed with the Clustal W algorithm (Thompson, J. D., Higgins, D. G., and Gibson T. J. (1994) Nuc. Acid Res. 22: 4673 4680) employing the following paramaters: 1) for pairwise alignment parameters, a Gap opening=10; Gap extend=0.1; matrix is Gonnet 250; and mode—Slow-accurate, 2) for multiple alignment parameters, Gap opening=10; Gap extension=0.2; and matrix is Gonnet series. For example, the three conserved cysteines are located at amino acid positions 56, 129, and 201 in the *Streptococcus mutans* DHAD (SEQ ID NO: 168), and at amino acid positions 61, 135, and 207 in the *Lactococcus lactis* DHAD (SEQ ID NO: 232). The exact positions of the three conserved cysteines in other protein sequences correspond to these positions in the *S. mutans* or the *L. lactis* amino acid sequence. One skilled in the art will readily be able to identify the presence or absence of each of the three conserved cysteines in the amino acid sequence of a DHAD protein using pairwise or multiple sequence alignments. In addition, other methods may be used to determine the presence of the three conserved cysteines, such as analysis by eye.

The DHAD Profile HMM matching proteins that have two but not the third (position 56) conserved cysteine include [4Fe-4S] DHADs and phosphogluconate dehydratases (EDDs). Proteins having the three conserved cysteines include arabonate dehydratases and [2Fe-2S] DHADs, and are members of a [2Fe-2S] DHAD/aldonic acid dehydratase group. The [2Fe-2S] DHADs may be distinguished from the aldonic acid dehydratases by analyzing for signature conserved amino acids found to be present in the [2Fe-2S] DHADs or in the aldonic acid dehydratases at positions corresponding to the following positions in the *Streptococcus mutans* DHAD amino acid sequence. These signature amino acids are in [2Fe-2S] DHADs or in aldonic acid dehydratases, respectively, at the following positions (with greater than 90% occurance): 88 asparagine vs glutamic acid; 113 not conserved vs glutamic acid; 142 arginine or asparagine vs not conserved; 165: not conserved vs glycine; 208 asparagine vs not conserved; 454 leucine vs not conserved; 477 phenylalanine or tyrosine vs not conserved; and 487 glycine vs not conserved.

The disclosed methods for identification of [2Fe-2S] DHAD enzymes can be carried out on a single sequence or on a group of sequences. In a preferred embodiment, one or more sequence databases are queried with a Profile HMM as described herein. Suitable sequence databases are known to those skilled in the art and include but are not limited to the Genbank non-redundant protein database, the SwissProt database, or UniProt database or other available databases such as GQPat (GenomeQuest, Westboro, Mass.) and BRENDA (Biobase, Beverly, Mass.).

Among the [2Fe-2S] DHADs identifiable by this method, bacterial [2Fe-2S] DHADs may readily be identifiable by the natural source organism being a type of bacteria. Any bacterial [2Fe-2S] DHAD identifiable by this method may be suitable for heterologous expression in a microbial host cell. It will also be appreciated that any bacterial [2Fe-2S] DHAD expressly disclosed herein by sequence may be suitable for heterologous expression in bacterial cells. Preferred bacterial [2Fe-2S] DHAD enzymes can be expressed in a host cell and provide DHAD activity.

Initially, 193 different bacterial [2Fe-2S] DHADs with sequence identities of less than 95% (greater than 95% identity proteins removed to simplify the analysis) were identified as described in Example 1 and the amino acid and coding sequences of these proteins are provided in the sequence listing, with SEQ ID NOs listed in Table 2a.

A subsequent analysis described in Example 11 returned 268 different bacterial [2Fe-2S] DHADs. Amino acid and coding sequences that were not identical to any of the 193 bacterial [2Fe-2S] DHADs provided by the initial identification are included in the sequence listing, with SEQ ID NOs listed in Table 2b.

Any [2Fe-2S] DHAD protein matching a sequence identifiable through the methods disclosed herein or a sequence expressly disclosed herein with an identity of at least about 95%, 96%, 97%, 98%, or 99% is a [2Fe-2S] DHAD that may be used for heterologous expression in bacterial cells as disclosed herein. Among the bacterial [2Fe-2S] DHADs expressly disclosed herein, there is 100% conservation of the signature amino acids at positions: 88 aspartic acid, 142 arginine or asparagine, 208 asparagine, and 454 leucine.

In addition, bacterial [2Fe-2S] DHADs that may be used in the present invention are identifiable by their position in the [2Fe-2S] DHAD branch of a phylogenetic tree of DHAD related proteins such as that shown in FIG. 2 and described in Example 1. In addition, bacterial [2Fe-2S] DHADs that may be used are identifiable using sequence comparisons with any of the 281 bacterial [2Fe-2S] DHADs whose sequences are provided herein, where sequence identity may be at least about 80%-85%, 85%-90%, 90%-95% or 95%-99%.

Additionally, the sequences of [2Fe-2S] DHADs provided herein may be used to identify other homologs in nature. For example each of the DHAD encoding nucleic acid fragments described herein may be used to isolate genes encoding homologous proteins. Isolation of homologous genes using sequence-dependent protocols is well known in the art. Examples of sequence-dependent protocols include, but are not limited to: 1.) methods of nucleic acid hybridization; 2.) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., *Proc. Acad. Sci. USA* 82:1074 (1985); or strand displacement amplification (SDA), Walker, et al., *Proc. Natl. Acad. Sci. U.S.A.*, 89:392 (1992)]; and 3.) methods of library construction and screening by complementation.

For example, genes encoding similar proteins or polypeptides to the [2Fe-2S] DHAD encoding genes provided herein could be isolated directly by using all or a portion of the instant nucleic acid fragments as DNA hybridization probes to screen libraries from any desired organism using methodology well known to those skilled in the art. Specific oligonucleotide probes based upon the disclosed nucleic acid sequences can be designed and synthesized by methods known in the art (Maniatis, supra). Moreover, the entire sequences can be used directly to synthesize DNA probes by methods known to the skilled artisan (e.g., random primers DNA labeling, nick translation or end-labeling techniques), or RNA probes using available in vitro transcription systems. In addition, specific primers can be designed and used to amplify a part of (or full-length of) the instant sequences. The resulting amplification products can be labeled directly during amplification reactions or labeled after amplification reactions, and used as probes to isolate full-length DNA fragments by hybridization under conditions of appropriate stringency.

Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein and Wallace, "The use of oligonucleotides as specific hybridization probes in the Diagnosis of Genetic Disorders", in *Human Genetic Diseases: A Practical Approach*, K. E. Davis Ed., (1986) pp 33-50, IRL: Herndon, Va.; and Rychlik, W., In *Methods in Molecular Biology*, White, B. A. Ed., (1993) Vol. 15, pp 31-39, PCR Protocols: Current Methods and Applications. Humania: Totowa, N.J.).

Generally two short segments of the described sequences may be used in polymerase chain reaction protocols to amplify longer nucleic acid fragments encoding homologous genes from DNA or RNA. The polymerase chain reaction may also be performed on a library of cloned nucleic acid fragments wherein the sequence of one primer is derived from the described nucleic acid fragments, and the sequence of the other primer takes advantage of the presence of the polyadenylic acid tracts to the 3' end of the mRNA precursor encoding microbial genes.

Alternatively, the second primer sequence may be based upon sequences derived from the cloning vector. For example, the skilled artisan can follow the RACE protocol (Frohman et al., *PNAS USA* 85:8998 (1988)) to generate cDNAs by using PCR to amplify copies of the region between a single point in the transcript and the 3' or 5' end. Primers oriented in the 3' and 5' directions can be designed from the instant sequences. Using commercially available 3' RACE or 5' RACE systems (e.g., BRL, Gaithersburg, Md.), specific 3' or 5' cDNA fragments can be isolated (Ohara et al., *PNAS USA* 86:5673 (1989); Loh et al., *Science* 243:217 (1989)).

Alternatively, the provided [2Fe-2S] DHAD encoding sequences may be employed as hybridization reagents for the identification of homologs. The basic components of a nucleic acid hybridization test include a probe, a sample suspected of containing the gene or gene fragment of interest, and a specific hybridization method. Probes are typically single-stranded nucleic acid sequences that are complementary to the nucleic acid sequences to be detected. Probes are "hybridizable" to the nucleic acid sequence to be detected. The probe length can vary from 5 bases to tens of thousands of bases, and will depend upon the specific test to be done. Typically a probe length of about 15 bases to about 30 bases is suitable. Only part of the probe molecule need be complementary to the nucleic acid sequence to be detected. In addition, the complementarity between the probe and the target sequence need not be perfect. Hybridization does occur between imperfectly complementary molecules with the result that a certain fraction of the bases in the hybridized region are not paired with the proper complementary base.

Hybridization methods are well defined. Typically the probe and sample must be mixed under conditions that will permit nucleic acid hybridization. This involves contacting the probe and sample in the presence of an inorganic or organic salt under the proper concentration and temperature conditions. The probe and sample nucleic acids must be in contact for a long enough time that any possible hybridization between the probe and sample nucleic acid may occur. The concentration of probe or target in the mixture will determine the time necessary for hybridization to occur. The higher the probe or target concentration, the shorter the hybridization incubation time needed. Optionally, a chaotropic agent may be added. The chaotropic agent stabilizes nucleic acids by inhibiting nuclease activity. Furthermore, the chaotropic agent allows sensitive and stringent hybridization of short oligonucleotide probes at room temperature (Van Ness and Chen, *Nucl. Acids Res.* 19:5143-5151 (1991)). Suitable chaotropic agents include guanidinium chloride, guanidinium thiocyanate, sodium thiocyanate, lithium tetrachloroacetate, sodium perchlorate, rubidium tetrachloroacetate, potassium iodide and cesium trifluoroacetate, among others. Typically, the chaotropic agent will be present at a final concentration of about 3 M. If desired, one can add formamide to the hybridization mixture, typically 30-50% (v/v).

Various hybridization solutions can be employed. Typically, these comprise from about 20 to 60% volume, preferably 30%, of a polar organic solvent. A common hybridization solution employs about 30-50% v/v formamide, about 0.15 to 1 M sodium chloride, about 0.05 to 0.1 M buffers (e.g., sodium citrate, Tris-HCl, PIPES or HEPES (pH range about 6-9)), about 0.05 to 0.2% detergent (e.g., sodium dodecylsulfate), or between 0.5-20 mM EDTA, FICOLL (Pharmacia Inc.) (about 300-500 kdal), polyvinylpyrrolidone (about 250-500 kdal) and serum albumin. Also included in the typical hybridization solution will be unlabeled carrier nucleic acids from about 0.1 to 5 mg/mL, fragmented nucleic DNA (e.g., calf thymus or salmon sperm DNA, or yeast RNA), and optionally from about 0.5 to 2% wt/vol glycine. Other additives may also be included, such as volume exclusion agents that include a variety of polar water-soluble or swellable agents (e.g., polyethylene glycol), anionic polymers (e.g., polyacrylate or polymethylacrylate) and anionic saccharidic polymers (e.g., dextran sulfate).

Nucleic acid hybridization is adaptable to a variety of assay formats. One of the most suitable is the sandwich assay format. The sandwich assay is particularly adaptable to hybridization under non-denaturing conditions. A primary component of a sandwich-type assay is a solid support. The solid support has adsorbed to it or covalently coupled to it immobilized nucleic acid probe that is unlabeled and complementary to one portion of the sequence.

Expression of Heterologous Bacterial [2Fe-2S] DHADs in Bacterial and Yeast Hosts Applicants have found that a heterologous [2Fe-2S] DHAD provides DHAD activity when expressed in a microbial cell. Any [2Fe-2S] DHAD which may be identified as described herein, may be expressed in a heterologous microbial cell. Expression of any of these proteins provides DHAD activity for a biosynthetic pathway that includes conversion of 2,3-dihydroxyisovalerate to α-ketoisovalerate or 2,3-dihydroxymethylvalerate to α-ketomethylvalerate. Expression of a [2Fe-2S] DHAD, as opposed to a 4Fe-4D DHAD, lowers the requirement for Fe and S in clusters to obtain enzyme activity. In addition, the *S. mutans* [2Fe-2S] DHAD was shown herein to have higher stability in air as compared to the sensitivity in air of the *E. coli* [4Fe-4S] DHAD, which is desirable for obtaining better activity in a heterologous host cell.

Bacterial cells that may be hosts for expression of a heterologous bacterial [2Fe-2S] DHAD include, but are not limited to, *Clostridium, Zymomonas, Escherichia, Salmonella, Rhodococcus, Pseudomonas, Bacillus, Lactobacillus, Enterococcus, Pediococcus, Alcaligenes, Klebsiella, Paenibacillus, Arthrobacter, Corynebacterium*, and *Brevibacterium, Lactococcus, Leuconostoc, Oenococcus, Pediococcus*, and *Streptococcus*. Engineering expression of a heterologous bacterial [2Fe-2S] DHAD may increase DHAD activity in a host bacterial cell that naturally expresses a [2Fe-2S] DHAD or a [4Fe-4S] DHAD. Such host cells may include, for example, *E. coli* and *Bacillus subtilis*. Furthermore, engineering expression of a heterologous bacterial [2Fe-2S] DHAD provides DHAD activity in a host bacterial cell that has no endogenous DHAD activity. Such host cells may include, for example, *Lactobacillus, Enterococcus, Pediococcus* and *Leuconostoc*.

Specific hosts include: *Escherichia coli, Alcaligenes eutrophus, Bacillus licheniformis, Paenibacillus macerans, Rhodococcus erythropolis, Pseudomonas putida, Lactobacillus plantarum, Enterococcus faecium, Enterococcus gallinarium, Enterococcus faecalis*, and *Bacillus subtilis*.

A host bacterial cell may be engineered to express a heterologous bacterial [2Fe-2S] DHAD by methods well known to one skilled in the art. The coding region for the DHAD to be expressed may be codon optimized for the target host cell, as well known to one skilled in the art. Vectors useful for the transformation of a variety of host cells are common and commercially available from companies such as EPICENTRE® (Madison, Wis.), Invitrogen Corp. (Carlsbad, Calif.), Stratagene (La Jolla, Calif.), and New England Biolabs, Inc. (Beverly, Mass.). Typically the vector contains a selectable marker and sequences allowing autonomous replication or chromosomal integration in the desired host. In addition, suitable vectors comprise a promoter region which harbors transcriptional initiation controls and a transcriptional termination control region, between which a coding region DNA fragment may be inserted, to provide expression of the inserted coding region. Both control regions may be derived from genes homologous to the transformed host cell, although it is to be understood that such control regions may also be derived from genes that are not native to the specific species chosen as a production host.

Initiation control regions or promoters, which are useful to drive expression of bacterial [2Fe-2S] DHAD coding regions in the desired bacterial host cell are numerous and familiar to those skilled in the art. Virtually any promoter capable of driving these genetic elements is suitable for the present invention including, but not limited to, lac, ara, tet, trp, $IP_L$, $IP_R$, T7, tac, and trc promoters (useful for expression in *Escherichia coli, Alcaligenes*, and *Pseudomonas*); the amy, apr, and npr promoters, and various phage promoters useful for expression in *Bacillus subtilis, Bacillus licheniformis*, and *Paenibacillus macerans*; nisA (useful for expression Gram-positive bacteria, Eichenbaum et al. *Appl. Environ. Microbiol.* 64(8):2763-2769 (1998)); and the synthetic P11 promoter (useful for expression in *Lactobacillus plantarum*, Rud et al., *Microbiology* 152:1011-1019 (2006)).

Termination control regions may also be derived from various genes native to the preferred hosts. Optionally, a termination site may be unnecessary; however, it is most preferred if included.

Certain vectors are capable of replicating in a broad range of host bacteria and can be transferred by conjugation. The complete and annotated sequence of pRK404 and three related vectors: pRK437, pRK442, and pRK442(H), are available. These derivatives have proven to be valuable tools for genetic manipulation in Gram-negative bacteria (Scott et al., *Plasmid* 50(1):74-79 (2003)). Several plasmid derivatives of broad-host-range Inc P4 plasmid RSF1010 are also available with promoters that can function in a range of Gram-negative bacteria. Plasmid pAYC36 and pAYC37, have active promoters along with multiple cloning sites to allow for heterologous gene expression in Gram-negative bacteria. Some vectors that are useful for transformation of *Bacillus subtilis* and *Lactobacillus* include pAMβ1 and derivatives thereof (Renault et al., *Gene* 183:175-182 (1996); and O'Sullivan et al., *Gene* 137:227-231 (1993)); pMBB1 and pHW800, a derivative of pMBB1 (Wyckoff et al. *Appl. Environ. Microbiol.* 62:1481-1486 (1996)); pMG1, a conjugative plasmid (Tanimoto et al., *J. Bacteriol.* 184:5800-5804 (2002)); pNZ9520 (Kleerebezem et al., *Appl. Environ. Microbiol.* 63:4581-4584 (1997)); pAM401 (Fujimoto et al., *Appl. Environ. Microbiol.* 67:1262-1267 (2001)); and pAT392 (Arthur et al., *Antimicrob. Agents Chemother.* 38:1899-1903 (1994)). Several plasmids from *Lactobacillus plantarum* have also been reported (van Kranenburg et al., *Appl. Environ. Microbiol.* 71(3):1223-1230 (2005)).

Chromosomal gene replacement tools are also widely available. For example, a thermosensitive variant of the broad-host-range replicon pWV101 has been modified to construct a plasmid pVE6002 which can be used to effect gene replacement in a range of Gram-positive bacteria (Maguin et al., *J. Bacteriol.* 174(17):5633-5638 (1992)). Additionally, in vitro transposomes are available from commercial sources such as EPICENTRE® to create random mutations in a variety of genomes.

Yeast cells that may be hosts for expression of a heterologous bacterial [2Fe-2S] DHAD are any yeast cells that are amenable to genetic manipulation and include, but are not limited to, *Saccharomyces, Schizosaccharomyces, Hansenula, Candida, Kluyveromyces, Yarrowia* and *Pichia*. Suitable strains include, but are not limited to, *Saccharomyces cerevisiae, Schizosaccharomyces pombe, Kluyveromyces lactis, Kluyveromyces thermotolerans, Candida glabrata, Candida albicans, Pichia stipitis* and *Yarrowia lipolytica*. Most suitable is *Saccharomyces cerevisiae*.

Expression is achieved by transforming with a gene comprising a sequence encoding any of these [2Fe-2S] DHADs. The coding region for the DHAD to be expressed may be codon optimized for the target host cell, as well known to one skilled in the art. Methods for gene expression in yeast are known in the art (see for example *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Expression of genes in yeast typically requires a promoter, operably linked to a coding region of interest, and a transcriptional terminator. A number of yeast promoters can be used in constructing expression cassettes for genes in yeast, including, but not limited to promoters derived from the following genes: CYC1, HIS3, GAL1, GAL 10, ADH1, PGK, PHO5, GAPDH, ADC1, TRP1, URA3, LEU2, ENO, TPI, CUP1, FBA, GPD, GPM, and AOX1. Suitable transcriptional terminators include, but are not limited to FBAt, GPDt, GPMt, ERG10t, GAL1t, CYC1, and ADH1.

Suitable promoters, transcriptional terminators, and [2Fe-2S] DHAD coding regions may be cloned into *E. coli*-yeast shuttle vectors, and transformed into yeast cells. These vectors allow strain propagation in both *E. coli* and yeast strains. Typically the vector used contains a selectable marker and sequences allowing autonomous replication or chromosomal integration in the desired host. Typically used plasmids in yeast are shuttle vectors pRS423, pRS424, pRS425, and pRS426 (American Type Culture Collection, Rockville, Md.), which contain an *E. coli* replication origin (e.g., pMB1), a yeast 2 origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with a chimeric gene encoding the described DHADs may be performed by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a ≥21 bp sequence at both the 5' and the 3' ends that sequentially overlap with each other, and with the 5' and 3' terminus of the vector DNA. For example, to construct a yeast expression vector for "Gene X', a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Confirming DHAD Activity

The presence of DHAD activity in a cell engineered to express a bacterial [2Fe-2S] DHAD can be confirmed using methods known in the art. As one example, and as demonstrated in the Examples herein, crude extracts from cells engineered to express a bacterial [2Fe-2S] DHAD may be used in a DHAD assay as described by Flint and Emptage (J. Biol. Chem. (1988) 263(8): 3558-64) using dinitrophenylhydrazine. In another example, and as demonstrated in the Examples herein, DHAD activity may be assayed by expressing a bacterial DHAD identifiable by the methods disclosed herein in a yeast strain that lacks endogenous DHAD activity. If DHAD activity is present, the yeast strain will grow in the absence of branched-chain amino acids. DHAD activity may also be confirmed by more indirect methods, such as by assaying for a downstream product in a pathway requiring DHAD activity. Any product that has α-ketoisovalerate or α-ketomethylvalerate as a pathway intermediate may be measured as an assay for DHAD activity. A list of such products includes, but is not limited to, valine, isoleucine, leucine, pantothenic acid, 2-methyl-1-butanol, 3-methyl-1-butanol and isobutanol.

Isobutanol Production

Expression of a bacterial [2Fe-2S] DHAD in bacteria or yeast, as described herein, provides the transformed, recombinant host cell with dihydroxy-acid dehydratase activity for conversion of 2,3-dihydroxyisovalerate to α-ketoisovalerate or 2,3-dihydroxymethylvalerate to α-ketomethylvalerate. Any product that has α-ketoisovalerate or α-ketomethylvalerate as a pathway intermediate may be produced with greater effectiveness in a bacterial or yeast strain disclosed herein having the described heterologous [2Fe-2S] DHAD. A list of such products includes, but is not limited to, valine, isoleucine, leucine, pantothenic acid, 2-methyl-1-butanol, 3-methyl-1-butanol and isobutanol.

For example, in yeast biosynthesis of valine includes steps of acetolactate conversion to 2,3-dihydroxy-isovalerate by acetohydroxyacid reductoisomerase (ILV5), conversion of 2,3-dihydroxy-isovalerate to α-ketoisovalerate (also called 2-keto-isovalerate) by dihydroxy-acid dehydratase, and conversion of α-ketoisovalerate to valine by branched-chain amino acid transaminase (BAT2) and branched-chain amino acid aminotransferase (BAT1). Biosynthesis of leucine includes the same steps to α-ketoisovalerate, followed by conversion of α-ketoisovalerate to alpha-isopropylmalate by alpha-isopropylmalate synthase (LEU9, LEU4), conversion of alpha-isopropylmalate to beta-isopropylmalate by isopropylmalate isomerase (LEU1), conversion of beta-isopropylmalate to alpha-ketoisocaproate by beta-IPM dehydrogenase (LEU2), and finally conversion of alpha-ketoisocaproate to leucine by branched-chain amino acid transaminase (BAT2) and branched-chain amino acid aminotransferase (BAT1). The bacterial pathway is similar, involving differently named proteins and genes. Increased conversion of 2,3-dihydroxy-isovalerate to α-ketoisovalerate will increase flow in these pathways, particularly if one or more additional enzymes of a pathway is overexpressed. Thus it is desired for production of valine or leucine to use a strain disclosed herein.

Biosynthesis of pantothenic acid includes a step performed by DHAD, as well as steps performed by ketopantoate hydroxymethyltransferase and pantothenate synthase. Engineering of expression of these enzymes for enhanced production of pantothenic acid biosynthesis in microorganisms is described in U.S. Pat. No. 6,177,264.

Figure 3:
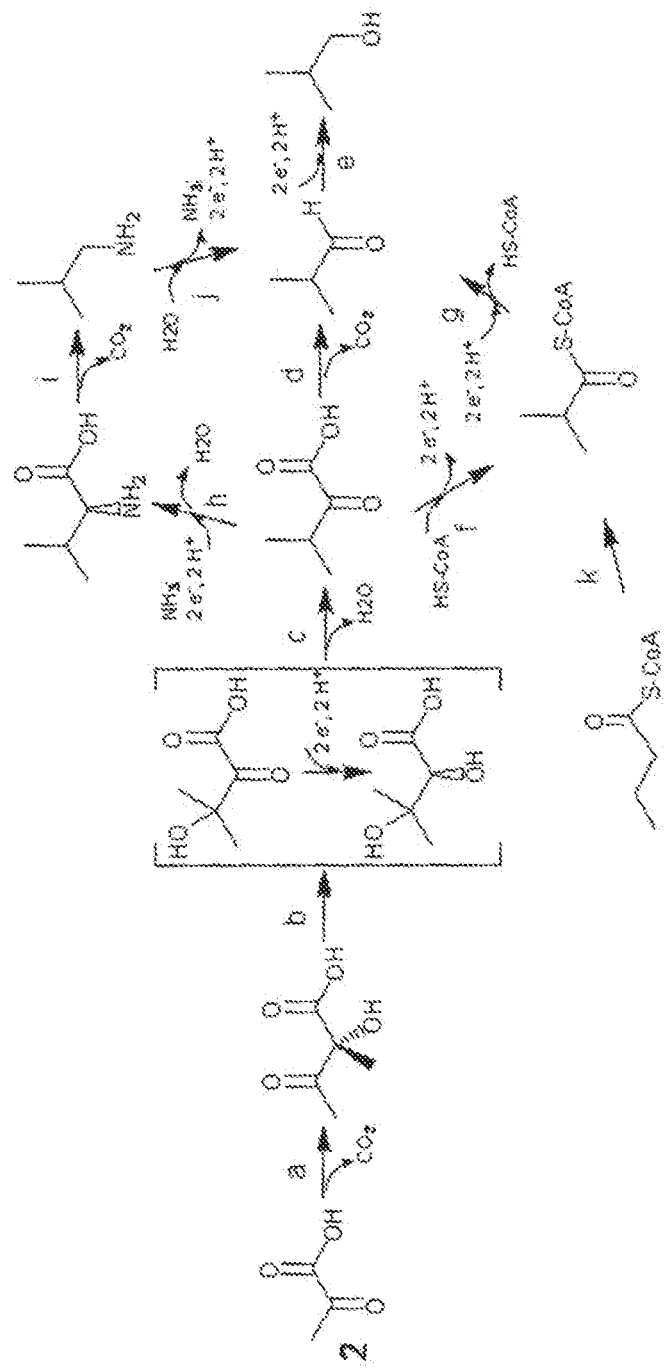
FIG. 3 shows biosynthetic pathways for isobutanol production.

The α-ketoisovalerate product of DHAD is an intermediate in isobutanol biosynthetic pathways disclosed in commonly owned and co-pending US Patent Publication 20070092957 A1, which is herein incorporated by reference. A diagram of the disclosed isobutanol biosynthetic pathways is provided in FIG. 3. Production of isobutanol in a strain disclosed herein benefits from increased DHAD activity. As disclosed herein, DHAD activity is provided by expression of a bacterial [2Fe-2S] DHAD in a bacterial or yeast cell. As described in US 20070092957 A1, steps in an example isobutanol biosynthetic pathway include conversion of:

pyruvate to acetolactate (see FIG. 1, pathway step a therein), as catalyzed for example by acetolactate synthase, acetolactate to 2,3-dihydroxyisovalerate (see FIG. 1, pathway step b therein) as catalyzed for example by acetohydroxy acid isomeroreductase;

2,3-dihydroxyisovalerate to α-ketoisovalerate (see FIG. 1, pathway step c therein) as catalyzed for example by acetohydroxy acid dehydratase, also called dihydroxy-acid dehydratase (DHAD);

α-ketoisovalerate to isobutyraldehyde (see FIG. 1, pathway step d therein) as catalyzed for example by branched-chain α-keto acid decarboxylase; and isobutyraldehyde to isobutanol (see FIG. 1, pathway step e therein) as catalyzed for example by branched-chain alcohol dehydrogenase.

The substrate to product conversions, and enzymes involved in these reactions, for steps f, g, h, l, j, and k of alternative pathways are described in US 20070092957 A1.

Genes that may be used for expression of the pathway step enzymes named above other than the bacterial [2Fe-2S] DHADs disclosed herein, as well as those for two additional isobutanol pathways, are described in US 20070092957 A1, and additional genes that may be used can be identified by one skilled in the art through bioinformatics or experimentally as described above. The preferred use in all three pathways of ketol-acid reductoisomerase (KARI) enzymes with particularly high activities is disclosed in commonly owned and co-pending US Patent Application Publication No. US20080261230A1. Examples of high activity KARIs disclosed therein are those from *Vibrio cholerae* (DNA: SEQ ID NO:389; protein SEQ ID NO:390), *Pseudomonas aeruginosa* PAO1, (DNA: SEQ ID NO: 422; protein SEQ ID NO:423), and *Pseudomonas fluorescens* PF5 (DNA: SEQ ID NO:391; protein SEQ ID NO:392).

Additionally described in US 20070092957 A1 are construction of chimeric genes and genetic engineering of bacteria and yeast for isobutanol production using the disclosed biosynthetic pathways.

Growth for Production

Recombinant bacteria or yeast hosts disclosed herein are grown in fermentation media which contains suitable carbon substrates. Additional carbon substrates may include but are not limited to monosaccharides such as fructose, oligosaccharides such as lactose maltose, galactose, or sucrose, polysaccharides such as starch or cellulose or mixtures thereof and unpurified mixtures from renewable feedstocks such as cheese whey permeate, cornsteep liquor, sugar beet molasses, and barley malt. Other carbon substrates may include ethanol, lactate, succinate, or glycerol.

Additionally the carbon substrate may also be one-carbon substrates such as carbon dioxide, or methanol for which metabolic conversion into key biochemical intermediates has been demonstrated. In addition to one and two carbon substrates, methylotrophic organisms are also known to utilize a number of other carbon containing compounds such as methylamine, glucosamine and a variety of amino acids for metabolic activity. For example, methylotrophic yeasts are known to utilize the carbon from methylamine to form trehalose or glycerol (Bellion et al., *Microb. Growth C1 Compd.* [Int. Symp.], 7th (1993), 415-32, Editor(s): Murrell, J. Collin; Kelly, Don P. Publisher: Intercept, Andover, UK). Similarly, various species of *Candida* will metabolize alanine or oleic acid (Sulter et al., *Arch. Microbiol.* 153:485-489 (1990)). Hence it is contemplated that the source of carbon utilized in the present invention may encompass a wide variety of carbon containing substrates and will only be limited by the choice of organism.

Although it is contemplated that all of the above mentioned carbon substrates and mixtures thereof are suitable in the present invention, preferred carbon substrates are glucose, fructose, and sucrose, or mixtures of these with C5 sugars such as xylose and/or arabinose for yeasts cells modified to use C5 sugars. Sucrose may be derived from renewable sugar sources such as sugar cane, sugar beets, cassaya, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in co-owned and co-pending U.S. Patent Application Publication No. 2007/0031918A1, which is herein incorporated by reference. Biomass refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

In addition to an appropriate carbon source, fermentation media must contain suitable minerals, salts, cofactors, buffers and other components, known to those skilled in the art, suitable for the growth of the cultures and promotion of an enzymatic pathway comprising a bacterial [2Fe-2S] DHAD.

Culture Conditions

Typically cells are grown at a temperature in the range of about 20° C. to about 40° C. in an appropriate medium. Suitable growth media in the present invention are common commercially prepared media such as Luria Bertani (LB) broth, Sabouraud Dextrose (SD) broth, Yeast Medium (YM) broth, or broth that includes yeast nitrogen base, ammonium sulfate, and dextrose (as the carbon/energy source) or YPD Medium, a blend of peptone, yeast extract, and dextrose in optimal proportions for growing most *Saccharomyces cerevisiae* strains. Other defined or synthetic growth media may also be used, and the appropriate medium for growth of the particular microorganism will be known by one skilled in the art of microbiology or fermentation science. The use of agents known to modulate catabolite repression directly or indirectly, e.g., cyclic adenosine 2':3'-monophosphate, may also be incorporated into the fermentation medium.

Suitable pH ranges for the fermentation of yeast are typically between pH 3.0 to pH 9.0, where pH 5.0 to pH 8.0 is preferred as the initial condition. Suitable pH ranges for the fermentation of other microorganisms are between pH 3.0 to pH 7.5, where pH 4.5.0 to pH 6.5 is preferred as the initial condition.

Fermentations may be performed under aerobic or anaerobic conditions, where anaerobic or microaerobic conditions are preferred.

Industrial Batch and Continuous Fermentations

Fermentation may be a batch method of fermentation. A classical batch fermentation is a closed system where the composition of the medium is set at the beginning of the fermentation and not subject to artificial alterations during the fermentation. Thus, at the beginning of the fermentation the medium is inoculated with the desired organism or organisms, and fermentation is permitted to occur without adding anything to the system. Typically, however, "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of end product or intermediate.

A variation on the standard batch system is the fed-batch system. Fed-batch fermentation processes are also suitable in the present invention and comprise a typical batch system with the exception that the substrate is added in increments as the fermentation progresses. Fed-batch systems are useful when catabolite repression is apt to inhibit the metabolism of the cells and where it is desirable to have limited amounts of substrate in the media. Measurement of the actual substrate concentration in fed-batch systems is difficult and is therefore estimated on the basis of the changes of measurable factors such as pH, dissolved oxygen and the partial pressure of waste gases such as $CO_2$. Batch and fed-batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.*, 36:227, (1992), herein incorporated by reference.

The fermentation culture may be adapted to continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density.

Continuous fermentation allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by the turbidity of the culture medium, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

It is contemplated that batch, fed-batch, continuous processes, or any known mode of fermentation is suitable for growth of the described recombinant microbial host cell. Additionally, it is contemplated that cells may be immobilized on a substrate as whole cell catalysts and subjected to fermentation conditions for isobutanol production.

Methods for Product Isolation from the Fermentation Medium

Bioproduced isobutanol may be isolated from the fermentation medium using methods known in the art such as for ABE fermentations (see for example, Durre, *Appl. Microbiol. Biotechnol.* 49:639-648 (1998), Groot et al., *Process Biochem.* 27:61-75 (1992), and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, or pervaporation.

Because isobutanol forms a low boiling point, azeotropic mixture with water, distillation can be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see for example Doherty and Malone, *Conceptual Design of Distillation Systems*, McGraw Hill, New York, 2001).

The butanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the first distillation column as reflux. The isobutanol-rich decanted organic phase may be further purified by distillation in a second distillation column.

The isobutanol may also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the butanol from the solvent.

Distillation in combination with adsorption may also be used to isolate isobutanol from the fermentation medium. In this method, the fermentation broth containing the isobutanol is distilled to near the azeotropic composition and then the remaining water is removed by use of an adsorbent, such as molecular sieves (Aden et al. *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo et al., *J. Membr. Sci.* 245, 199-210 (2004)).

EXAMPLES

The present invention is further defined in the following Examples. It should be understood that these Examples, while indicating a preferred embodiment of the invention, are given by way of illustration only. From the above discussion and these Examples, one skilled in the art can ascertain the essential characteristics of this invention and, without departing from the spirit and scope thereof, can make various changes and modifications of the invention to adapt it to various uses and conditions.

General Methods

Standard recombinant DNA and molecular cloning techniques described in the Examples are well known in the art and are described by Sambrook, J., Fritsch, E. F. and Maniatis, T. *Molecular Cloning: A Laboratory Manual*; Cold Spring Harbor Laboratory Press: Cold Spring Harbor, N.Y., (1989) (Maniatis) and by T. J. Silhavy, M. L. Bennan, and L. W. Enquist, *Experiments with Gene Fusions*, Cold Spring Harbor Laboratory Press, Cold Spring Harbor, N.Y. (1984) and by Ausubel, F. M. et al., *Current Protocols in Molecular Biology*, pub. by Greene Publishing Assoc. and Wiley-Interscience (1987) and by *Methods in Yeast Genetics*, 2005, Cold Spring Harbor Laboratory Press, Cold Spring Harbor, N.Y.

Materials and Methods suitable for the maintenance and growth of bacterial cultures are well known in the art. Techniques suitable for use in the following Examples may be found as set out in *Manual of Methods for General Bacteriology* (Phillipp Gerhardt, R. G. E. Murray, Ralph N. Costilow, Eugene W. Nester, Willis A. Wood, Noel R. Krieg and G. Briggs Phillips, eds), American Society for Microbiology, Washington, D.C. (1994)) or by Thomas D. Brock in *Biotechnology: A Textbook of Industrial Microbiology*, Second Edition, Sinauer Associates, Inc., Sunderland, Mass. (1989). All reagents, restriction enzymes and materials used for the growth and maintenance of bacterial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.) unless otherwise specified.

Microbial strains were obtained from The American Type Culture Collection (ATCC), Manassas, Va., unless otherwise noted. The oligonucleotide primers used in the following Examples were synthesized by Sigma-Genosys (Woodlands, Tex.) or Integrated DNA Technologies (Coralsville, Iowa).

Synthetic complete medium is described in Amberg, Burke and Strathern, 2005, Methods in Yeast Genetics, Cold Spring Harbor Laboratory Press, Cold Spring Harbor, N.Y.

HPLC

Analysis for fermentation by-product composition is well known to those skilled in the art. For example, one high performance liquid chromatography (HPLC) method utilizes a Shodex SH-1011 column with a Shodex SH-G guard column (both available from Waters Corporation, Milford, Mass.), with refractive index (RI) detection. Chromatographic separation is achieved using 0.01 M $H_2SO_4$ as the mobile phase with a flow rate of 0.5 mL/min and a column temperature of 50° C. Isobutanol retention time is about 47.6 minutes.

The meaning of abbreviations is as follows: "s" means second(s), "min" means minute(s), "h" means hour(s), "psi" means pounds per square inch, "nm" means nanometers, "d" means day(s), "μL" means microliter(s), "mL" means milliliter(s), "L" means liter(s), "mm" means millimeter(s), "nm" means nanometers, "mM" means millimolar, "μM" means micromolar, "M" means molar, "mmol" means millimole(s), "μmol" means micromole(s)", "g" means gram(s), "μg" means microgram(s) and "ng" means nanogram(s), "PCR" means polymerase chain reaction, "OD" means optical density, "OD600" means the optical density measured at a wavelength of 600 nm, "kDa" means kilodaltons, "g" means the gravitation constant, "bp" means base pair(s), "kbp" means kilobase pair(s), "~" means about, "% w/v" means weight/volume percent, % v/v" means volume/volume percent, "HPLC" means high performance liquid chromatography, and "GC" means gas chromatography.

Example 1

Identification of Bacterial Dihydroxy-Acid Dehydratases with [2Fe-2S] Cluster

Phylogenetic Analysis

Phylogenetic relationships were determined for dihydroxy-acid dehydratases (DHADs) and related proteins. Related proteins were identified through BlastP searches of publicly available databases using amino acid sequences of *E. coli* DHAD (SEQ ID NO:382), *E. coli* phosphogluconate dehydratase (EDD; SEQ ID NO:384; coding region SEQ ID NO:383), and *Azospirillum brasiliense* arabonate dehydratase (SEQ ID NO:386; coding region SEQ ID NO:385), with the following search parameters: E value=10, word size=3, Matrix=Blosum62, and Gap opening=11 and gap extension=1. Blast searches employing the three different protein sequences generated overlapping sets of sequence matches. Sequences were selected from the search results based on E value cutoff of $10^{-5}$ with removal of 95% identity sequences. Sequences that were shorter than 350 amino acids and sequences that were longer than 650 amino acids were also removed. The resultant set of 976 amino acid sequences included dihydroxy-acid dehydratases, phosphogluconate dehydratases, and aldonic acid dehydratases.

A profile HMM was generated from the experimentally verified DHADs described in Example 2. See details below on building, calibrating, and searching with this profile HMM. An hmmer search, using this profile HMM as a query, against the 976 sequences matched all sequences with an E value of <10$^{-5}$. Multiple sequence alignments of the amino acid sequences were performed with the Clustal W algorithm (Thompson, J. D., Higgins, D. G., and Gibson T. J. (1994) Nuc. Acid Res. 22: 4673 4680) employing the following paramaters: 1) for pairwise alignment parameters, a Gap opening=10; Gap extend=0.1; matrix is Gonnet 250; and mode—Slow-accurate, 2) for multiple alignment parameters, Gap opening=10; Gap extension=0.2; and matrix is Gonnet series. Phylogenetic trees were generated from sequence alignments based on the Neighbor Joining method. A tree representing phylogenetic relationships among the 976 sequences is shown in FIG. 2. Four main main branches emerged from this analysis. They are labeled "4Fe-4S DHAD", "2Fe-2S DHAD", "aldonic acid dehydratase", and "EDD", based on the criteria detailed below. A fifth small branch of 17 sequences is marked as "Und" for undefined.

The aligned sequences were initially analyzed for the presence of three cysteines determined to be essential for enzyme activity and likely involved in Fe—S coordination in the *Azospirillum brasiliense* arabonate dehydratase, which was reported as a [4Fe-4S] cluster protein (Watanabe, S et al. *J. Biol. Chem.* (2006) 281:33521-33536). Each of the 976 sequences has the cysteines corresponding to two of the *Azospirillum brasiliense* arabonate dehydratase essential cysteines (at positions 124 and 197). Within the phylogenetic tree, there is a branch of 168 sequences that includes the [4Fe-4S]phosphogluconate dehydratase of *Zymomonas mobilis* (Rodriguez, M. et. al. (1996) *Biochem Mol Biol Int.* 38:783-789). Only the four amino acids alanine, valine or serine or glycine, but not cysteine, were found at the position of the third essential cysteine of the *A. brasiliense* arabonate dehydratase (position 56). This 168 sequence branch is labeled in FIG. 2 as "EDD".

A different branch of the tree contains 322 sequences, among which is the known [4Fe-4S] cluster DHAD of *E. coli*. This 322 sequence branch is labeled in FIG. 2 as "4Fe-4S DHAD". All sequences within this branch, and in the branch of 17 sequences ("Und"), contain glycine at the position corresponding to the third cysteine. The remaining 469 sequences, which are clustered in two branches and comprise both the aldonic acid recognizing *A. brasiliense* arabonate dehydratase and a set of DHADs, possess all three cysteines. These cysteines are at positions 56, 129, and 201 in the *S. mutans* DHAD (SEQ ID NO: 168) and at positions 61, 135, and 207 in the *L. lactis* DHAD (SEQ ID NO: 232). Shown in FIG. 1 are examples of regions from multiple sequence alignments that include the conserved cysteines.

Further analysis of multiple sequence alignments and of phylogenetic trees was performed to identify DHAD-specific residues (signatures) to distinguish DHADs from the arabonate dehydratases and other aldonic acid dehydratases. Among sequences containing the three specified conserved cysteines, a clade of 274 sequences was found to contain the DHADs from *S. mutans* and *L. lactis*. The *A. brasiliense* arabonate dehydratase was found in a separate clade of 195 sequences. Multiple sequence alignments containing the sequences from the DHAD group of 274, the aldonic acid dehydratase group, and the "[4Fe-4S] DHAD" branch were analyzed for conserved residues at each position. A set of residues that are conserved in a majority of both DHAD groups, but not in the aldonic acid dehydratases group, was detected and is shown in Table 4. Additionally, residues that are conserved in the aldonic acid dehydratases, but not in either of the two DHAD groups were also found. Such differentially conserved residues may act as substrate specificity determinants in their respective enzymes.

TABLE 4

Conserved residues* discriminating DHADs from aldonic acid dehydratases

| Position* | [4Fe—4S] DHAD | DHAD-274 group | Aldonic acid Dehydratase |
|---|---|---|---|
| 88 | Asp | Asp | Glu |
| 113 | NC** | NC | Glu |
| 142 | Arg | Arg or Asn | NC |
| 165 | NC | NC | Gly |
| 208 | Asn | Asn | NC |
| 454 | Leu | Leu | NC |
| 477 | Phe | Phe or Tyr | NC |
| 487 | Gly | Gly | NC |

Residue(s) conserved in a >90% majority of representatives.
*Position numbering is a based on the position in the S. mutans DHAD
**Not Conserved The group of DHADs forming the 274-sequence clade that does not include [4Fe-4S] cluster *E. coli* DHAD, [4Fe-4S] cluster *Z. mobilis* phosphogluconate dehydratase, or the reportedly [4Fe-4S] cluster *A. brasiliense* arabonate dehydratase, was differentially identified from the other groups by phylogeny and conserved residues found in multiple sequence alignments as described above. Consistent with the proposal that the group includes [2Fe-2S] cluster DHADs, the *Arabidopsis thaliana* DHAD and the *S. solfataricus* DHAD are part of the group. Because *Arabidopsis thaliana* is a plant as is spinach, and the spinach DHAD has been identified as a [2Fe-2S] cluster DHAD (Flint and Emptage (1988) *J. Biol. Chem.* 263:3558-3564), the *Arabidopsis thaliana* DHAD may be a [2Fe-2S] cluster DHAD. The *S. solfataricus* DHAD is reported to be oxygen resistant like the spinach [2Fe-2S] cluster DHAD, (Kim and Lee (2006) *J. Biochem.* 139, 591-596) which is an indication that the *S. solfataricus* DHAD may be a [2Fe-2S] cluster DHAD.

Figure 4A:
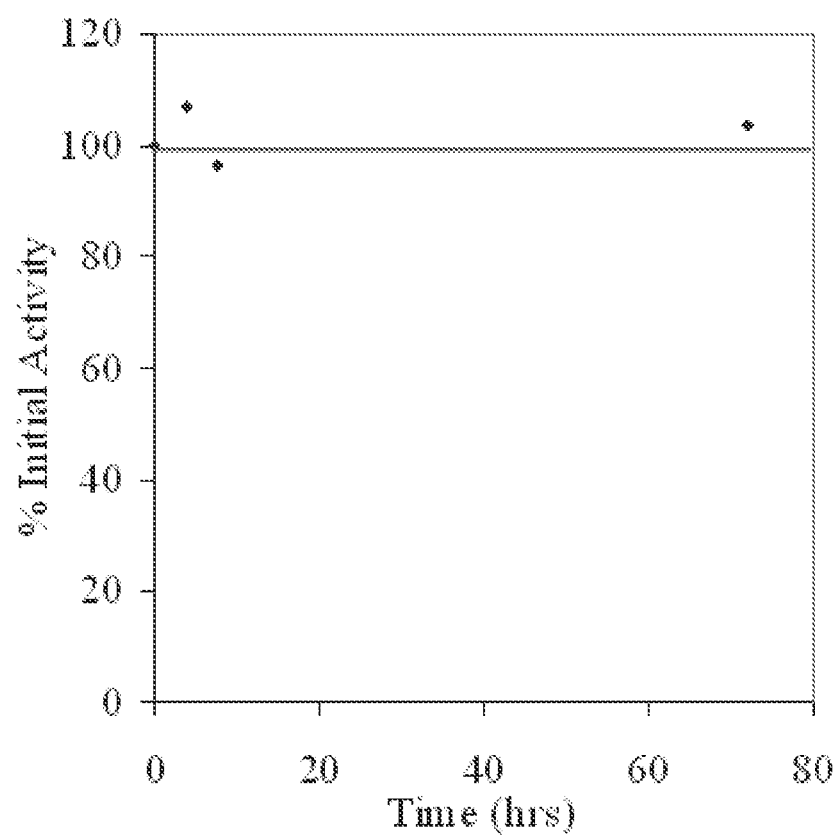
FIG. 4 shows graphs of stability of activity in air of A) *S. mutans* DHAD, and B) *E. coli* DHAD.
Figure 4B:
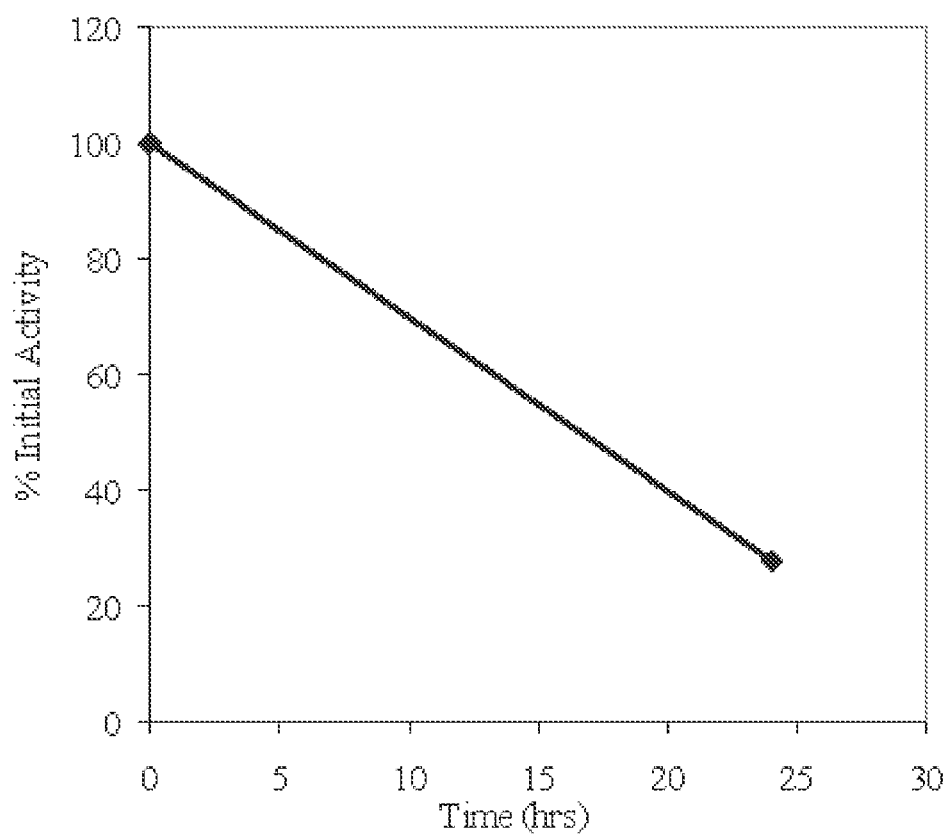

The 274 sequence clade is labeled on FIG. 4 as "2Fe-2S DHAD". 193 of these sequences are from bacterial sources. The three conserved cysteines and the conserved residues specified in Table 4 can be identified in multiple sequence alignments of the 193 bacterial DHADs, employing the alignment procedure described above. The sequences of the 193 bacterial [2Fe-2S] DHADs are provided in the sequence listing and the SEQ ID NOs are listed in Table 2a.

Within the [2Fe-2S] DHAD group, the identities of several bacterial proteins have been confirmed by functional analysis as DHADs, which is described in other examples herein. Other examples herein show that proteins in this group, such as the *S. mutans* DHAD and the *L. lactis* DHAD, contain a [2Fe-2S] cluster.

Preparation of Profile HMM

Seven bacterial DHADs that were identified as members of the [2Fe-2S] phylogenetic group were expressed in *E. coli* and dihydroxy-acid dehydratase activity was found as described in Example 2 below. These DHADs are from *Nitrosomonas europaea* (SEQ ID NO:310), *Synechocystis* sp. PCC6803 (SEQ ID NO: 298), *Streptococcus mutans* (SEQ ID NO:168), *Streptococcus thermophilus* (SEQ ID NO:164), *Ralstonia metallidurans* (SEQ ID NO:346), *Ralstonia eutropha* (SEQ ID NO:344), and *Lactococcus lactis* (SEQ ID NO:232). In addition the DHAD from *Flavobacterium johnsoniae* (SEQ ID NO:230) was found to have dihydroxy-acid dehydratase activity when expressed in *E. coli*. The amino acid sequences of these experimentally determined functional bacterial DHADs were analyzed using the HMMER software package (The theory behind profile HMMs is described in R. Durbin, S. Eddy, A. Krogh, and G. Mitchison, *Biological sequence analysis: probabilistic models of proteins and nucleic acids*, Cambridge University Press, 1998; Krogh et al., 1994; J. Mol. Biol. 235:1501-1531), following the user guide which is available from HMMER (Janelia Farm Research Campus, Ashburn, Va.). The output of the HMMER software program is a Profile Hidden Markov Model (HMM) that characterizes the input sequences. As stated in the user guide, Profile HMMs are statistical models of multiple sequence alignments. They capture position-specific information about how conserved each column of the alignment is, and which amino acid residues are most likely to occur at each position. Thus HMMs have a formal probabilistic basis. Profile HMMs for a large number of protein families are publicly available in the PFAM database (Janelia Farm Research Campus, Ashburn, Va.).

The Profile HMM was built as follows:

Step 1. Build a Sequence Alignment

The eight sequences for the functionally verified DHADs listed above were aligned using Clustal W with default parameters.

Step 2. Build a Profile HMM

The hmmbuild program was run on the set of aligned sequences using default parameters. hmmbuild reads the multiple sequence alignment file, builds a new Profile HMM, and saves the Profile HMM to file. Using this program an uncalibrated profile was generated from the multiple alignment for each set of subunit sequences described above.

The following information based on the HMMER software user guide gives some description of the way that the hmmbuild program prepares a Profile HMM. A Profile HMM is capable of modeling gapped alignments, e.g. including insertions and deletions, which lets the software describe a complete conserved domain (rather than just a small ungapped motif). Insertions and deletions are modeled using insertion (I) states and deletion (D) states. All columns that contain more than a certain fraction x of gap characters will be assigned as an insert column. By default, x is set to 0.5. Each match state has an I and a D state associated with it. HMMER calls a group of three states (M/D/I) at the same consensus position in the alignment a "node". These states are interconnected with arrows called state transition probabilities. M and I states are emitters, while D states are silent. The transitions are arranged so that at each node, either the M state is used (and a residue is aligned and scored) or the D state is used (and no residue is aligned, resulting in a deletion-gap character, '-'). Insertions occur between nodes, and I states have a self-transition, allowing one or more inserted residues to occur between consensus columns.

The scores of residues in a match state (i.e. match state emission scores), or in an insert state (i.e. insert state emission scores) are proportional to $Log\_2 (p\_x)/(null\_x)$. Where $p\_x$ is the probability of an amino acid residue, at a particular position in the alignment, according to the Profile HMM and $null\_x$ is the probability according to the Null model. The Null model is a simple one state probabilistic model with pre-calculated set of emission probabilities for each of the 20 amino acids derived from the distribution of amino acids in the SWISSPROT release 24.

State transition scores are also calculated as log odds parameters and are proportional to $Log\_2 (t\_x)$. Where $t\_x$ is the probability of transiting to an emitter or non-emitter state.

Step 3. Calibrate the Profile HMM

The Profile HMM was read using hmmcalibrate which scores a large number of synthesized random sequences with the Profile (the default number of synthetic sequences used is 5,000), fits an extreme value distribution (EVD) to the histogram of those scores, and re-saves the HMM file now including the EVD parameters. These EVD parameters ($\mu$ and $\lambda$) are used to calculate the E-values of bit scores when the profile is searched against a protein sequence database. hmmcalibrate writes two parameters into the HMM file on a line labeled "EVD": these parameters are the $\mu$ (location) and $\lambda$ (scale) parameters of an extreme value distribution (EVD) that best fits a histogram of scores calculated on randomly generated sequences of about the same length and residue composition as SWISS-PROT. This calibration was done once for the Profile HMM.

The calibrated Profile HMM for the DHAD set of sequences is provided in Table 1. The Profile HMM is provided in a chart that gives the probability of each amino acid occurring at each position in the amino acid sequence. The highest probability is highlighted for each position. The first line for each position reports the match emission scores: probability for each amino acid to be in that state (highest score is highlighted). The second line reports the insert emission scores, and the third line reports on state transition scores: M→M, M→I, M→D; I→M, I→I; D→M, D→D; B→M; M→E.

For example, the DHAD Profile HMM shows that methionine has a 1757 probability of being in the first position, the highest probability which is highlighted. In the second position glutamic acid has the highest probability, which is 1356. In the third position lysine has the highest probability, which is 1569.

Step 4. Test the Specificity and Sensitivity of the Built Profile HMMs

The Profile HMM was evaluated using hmmsearch, which reads a Profile HMM from hmmfile and searches a sequence file for significantly similar sequence matches. The sequence file searched contained 976 sequences (see above). During the search, the size of the database (Z parameter) was set to 1 billion. This size setting ensures that significant E-values against the current database will remain significant in the foreseeable future. The E-value cutoff was set at 10.

A hmmer search with the Profile HMM generated from the alignment of the eight DHADs with experimentally verified function, matched all 976 sequences with an E value $<10^{-5}$. This result indicates that members of the dehydratase super-family share significant sequence similarity. A hmmer search with a cutoff of E value $10^{-5}$ was used to separate DHAD related dehydratases from other more remote but related proteins, as described above.

Example 2

Expression and Characterization of Bacterial [2Fe-2S] Dihydroxy-Acid Dehydratases in *E. coli*

The ilvD coding regions from different bacteria, which from the phylogenetic analysis described in Example 1 are in the [2Fe-2S] group, were expressed under the control of the T7 promoter in vector pET28a (Novagen) in *E. coli*. Each ilvD coding region was amplified with a specific forward primer with an NheI restriction site and a specific reverse primer with a NotI restriction site (listed in Table 5).

TABLE 5

SEQ ID NOs of primers used for PCR of DHAD coding regions from the listed organisms.

| Organism | Forward primer SEQ ID NO | Reverse Primer SEQ ID NO |
|---|---|---|
| Nitrosomonas europaea ATCC 19718 | 424 | 401 |
| Synechocystis sp. PCC 6803 | 399 | 400 |
| Streptococcus mutans UA159 (ATCC 700610) | 435 | 436 |
| Streptococcus thermophilus LMG 18311 | 395 | 396 |
| Ralstonia metallidurans CH34 | 404 | 405 |
| Ralstonia eutropha H16 (ATCC 17699) | 406 | 407 |
| Lactococcus lactis | 420 | 421 |

The genomic DNA of each bacterial strain was used as a template. Genomic DNA was prepared from each strain listed in Table 1 using a MasterPure DNA Purification Kit (Epicentre, Madison, Wis.). The plasmid vector was amplified with primers pET28α-F(NotI) (SEQ ID NO:397) and pET28α-R (NheI) (SEQ ID NO:398) to remove the his tag region. Both gene and plasmid fragments were digested with NheI and NotI before ligation. The ligation mixture was transformed into E. coli (Top 10) competent cells (Invitrogen). Transformants were grown in LB agar plates supplemented with 50 μg/ml of kanamycin. Positive clones that were confirmed by sequencing were transformed into the E. coli Tuner (DE3) strain (Novagen) for expression. Selected colonies were grown in LB liquid medium supplemented with kanamycin at 30° C. Induction was carried out by adding 0.5 mM of IPTG when the E. coli culture reached an O.D. of 0.3 to 0.4 at 600 nm. The culture was harvested after 5 hours of induction. Cell pellets were washed with Tris buffer (pH 8.0).

Enzymatic activity of the crude extract was assayed at 37° C. as follows. Cells to be assayed for DHAD were suspended in 2-5 volumes of 50 mM Tris, 10 mM MgSO$_4$, pH 8.0 (TM8) buffer, then broken by sonication at 0° C. The crude extract from the broken cells was centrifuged to pellet the cell debris. The supernatants were removed and stored on ice until assayed (initial assay was within 2 hrs of breaking the cells). It was found that the DHADs assayed herein were stable in crude extracts kept on ice for a few hours. The activity was also preserved when small samples were frozen in liquid N$_2$ and stored at −80° C.

The supernatants were assayed using the reagent 2,4-dinitrophenyl hydrazine as described in Flint and Emptage (J. Biol. Chem. (1988) 263: 3558-64). When the activity was so high that it became necessary to dilute the crude extract to obtain an accurate assay, the dilution was done in 5 mg/ml BSA in TM8.

Protein assays were performed using the Pierce Better Bradford reagent (cat 23238) using BSA as a standard. Dilutions for protein assays were made in TM8 buffer when necessary.

All of the DHADs were active when expressed in E. coli, and the specific activities are given in Table 6. The DHAD from Streptococcus mutans had the highest specific activity.

TABLE 6

Activities of bacterial [2Fe—2S] DHADs in E. coli

| Organism Source of DHAD | SEQ ID NO of DHAD coding sequence | Specific Activity (μmol min$^{-1}$ mg$^{-1}$) |
|---|---|---|
| Nitrosomonas europaea ATCC 19718 | 309 | 3.3 |
| Synechocystis sp. PCC 6803 | 297 | 3.5 |
| Streptococcus mutans UA159 (ATCC 700610) | 167 | 7.9 |
| Streptococcus thermophilus LMG 18311 | 163 | 6.6 |
| Ralstonia metallidurans CH34 | 404 | 2.4 |
| Ralstonia eutropha H16 (ATCC 17699) | 406 | 4.1 |
| Lactococcus lactis | 231 | 2.1 |
| Vector control | N/A | 0.07 |

Example 3

Purification and Characterization of DHAD from Streptococcus mutans Expressed in E. coli The DHAD from S. mutans was further purified and characterized. For purification of the S. mutans DHAD, six liters of culture of the E. coli Tuner strain harboring the pET28a plasmid with the S. mutans ilvD were grown and induced with IPTG. The enzyme was purified by breaking the cells, as described in Example 2, in a 50 mM Tris buffer pH 8.0 containing 10 mM MgCl$_2$ (TM8 buffer), centrifuging to remove cell debris, then loading the supernatant of the crude extract on a Q Sepharose (GE Healthcare) column and eluting the DHAD with an increasing concentration of NaCl in TM8 buffer. The fractions containing the DHAD based on the color appearance (brownish color is due to the presence of the Fe—S cluster) were pooled and loaded onto a Sephacryl S-100 (GE Healthcare) column and eluted with TM8 buffer. As judged by SDS gels, the purity of the protein eluted from the Sephacryl column was estimated to be 60-80%. The activity of the partially purified enzyme was assayed at 37° C. as described by Flint et al. (J. Biol. Chem. (1988) 263(8): 3558-64). The specific activity of the purified protein was 40 μmol min$^{-1}$ mg$^{-1}$. The k$_{cat}$ for the purified enzyme was estimated to be 50-70 sec$^{-1}$.

Stability of the purified DHAD in air was studied by incubating the purified enzyme at 23° C. for various time intervals in the presence of ambient air, followed by an activity assay as described above. The activity of the DHAD from Streptococcus mutans, in contrast to DHAD purified similarly from E. coli, was stable even after 72 hours of incubation as shown in FIG. 4, where (A) shows results from the S. mutans DHAD and (B) shows results from the E. coli DHAD.

Figure 5:
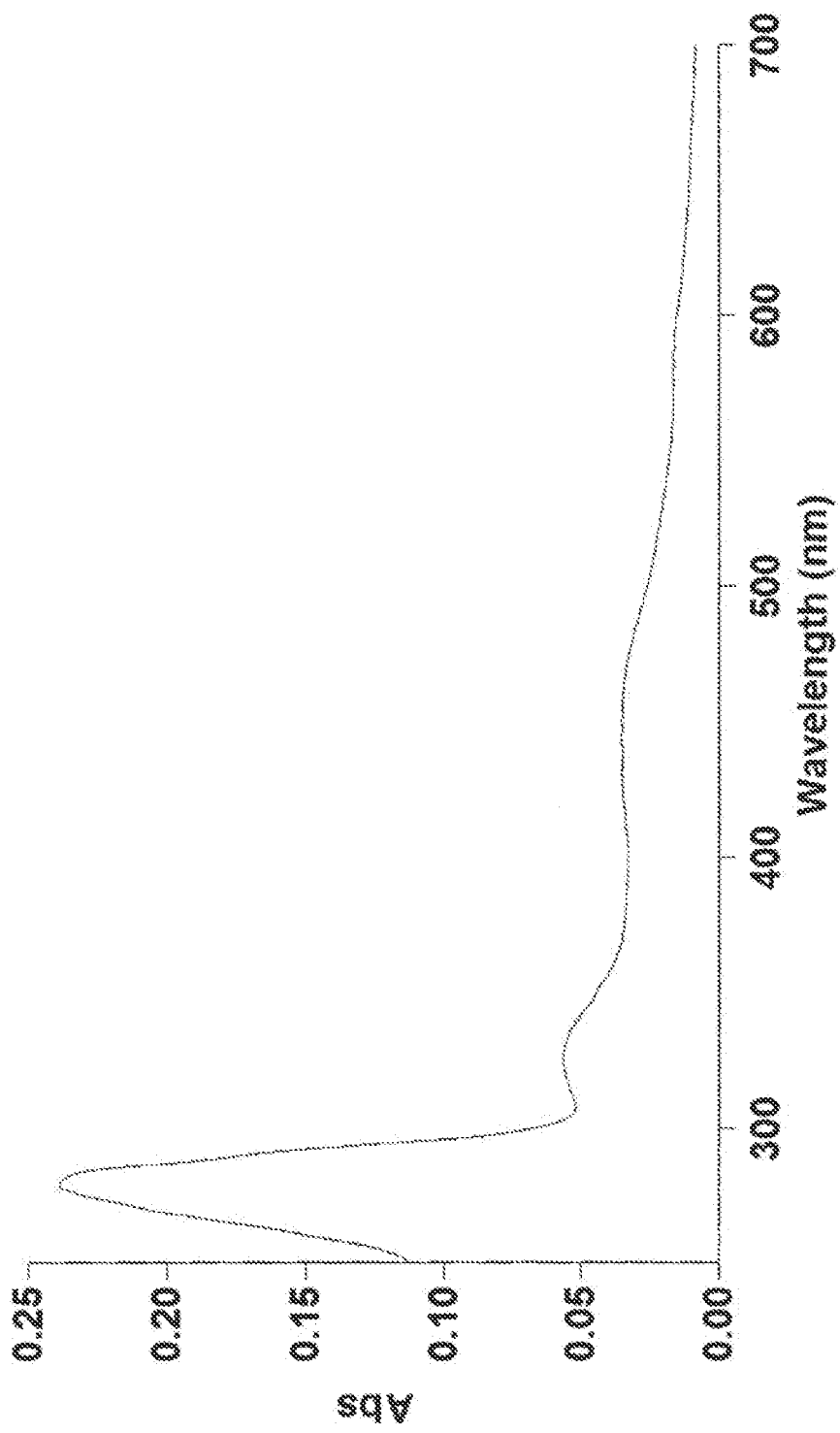
FIG. 5 shows a plot of the UV-visible spectrum of *S. mutans* DHAD.
Figure 6:
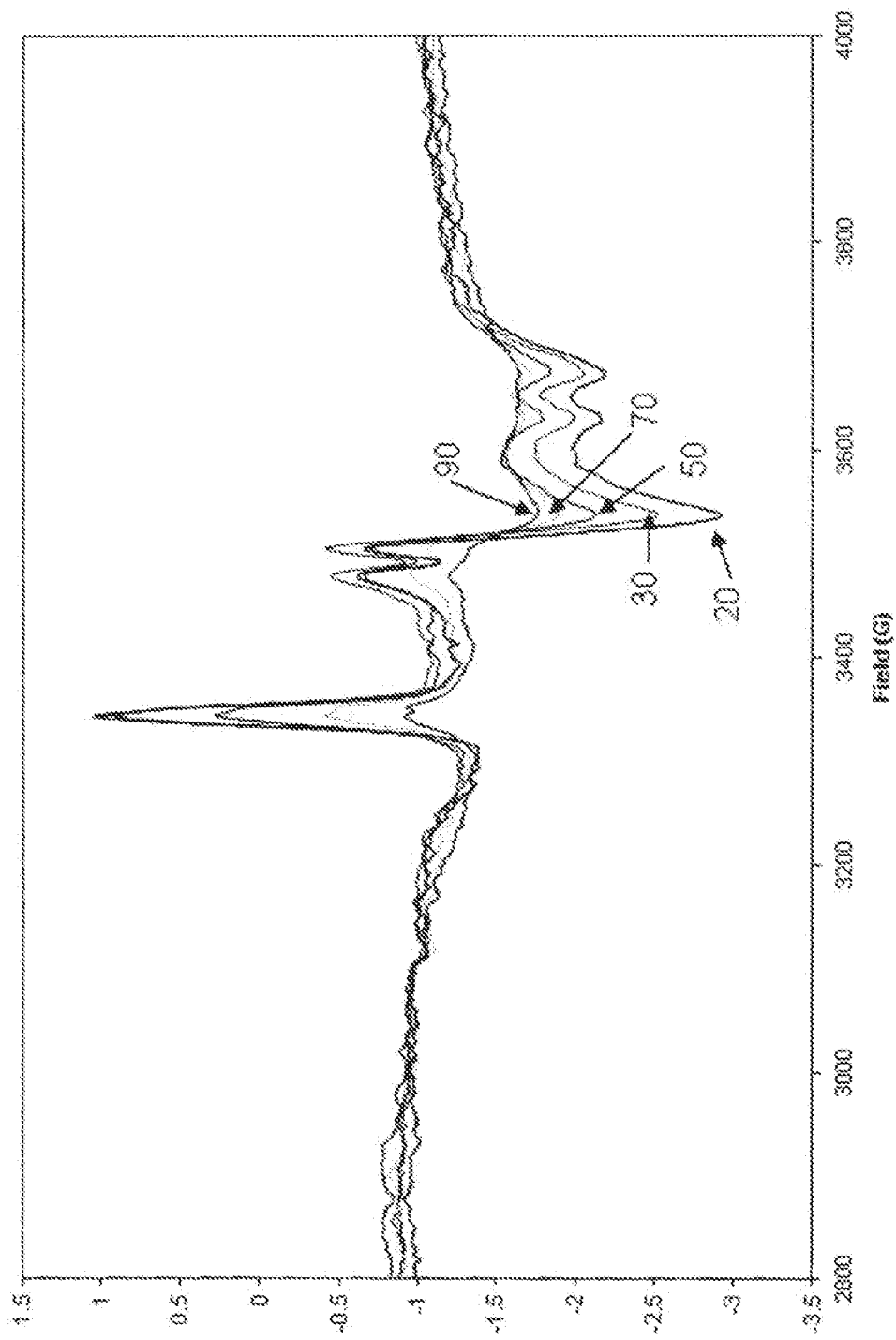
FIG. 6 shows a plot of the electron paramagnetic resonance (EPR) spectrum of *S. mutans* DHAD at different temperatures between 20° K. and 90° K.

The UV-visible spectrum of the purified S. mutans is shown in FIG. 5. The number of peaks above 300 nm is typical of proteins with [2Fe-2S] clusters. The S. mutans DHAD was reduced with sodium dithionite and EPR spectra were obtained at varying temperatures. FIG. 6 show spectra measured at temperatures between 20° K. and 70° K. That the EPR spectrum of S. mutans is measureable up to 70° K. is indicative that it contains a [2Fe-2S] cluster. It is well known for example that the EPR spectra of proteins containing [4Fe-4S] clusters are not observable at temperatures much above 10° K. (See, for example, Rupp, et al. Biochimica et Biophysica Acta (1978) 537:255-269.)

Example 4

Construction of Dihydroxy-Acid Dehydratase (DHAD) Expression Cassettes for Lactobacillus plantarum The purpose of this example is to describe how to clone and express a dihydroxy-acid dehydratase gene (ilvD) from different bacterial sources in *Lactobacillus plantarum* PN0512 (ATCC PTA-7727). A shuttle vector pDM1 (SEQ ID NO:410) was used for cloning and expression of ilvD genes from *Lactococcus lactis* subsp *lactis* NCDO2118 (NCIMB 702118) [Godon et al., J. Bacteriol. (1992) 174:6580-6589] and *Streptococcus mutans* UA159 (ATCC 700610) in *L. plantarum* PN0512. Plasmid pDM1 contains a minimal pLF1 replicon (~0.7 Kbp) and pemK-pemI toxin-antitoxin (TA) from *Lactobacillus plantarum* ATCC14917 plasmid pLF1, a P15A replicon from pACYC184, chloramphenicol marker for selection in both *E. coli* and *L. plantarum*, and P30 synthetic promoter [Rud et al, *Microbiology* (2006) 152:1011-1019]. Plasmid pLF1 (C.-F. Lin et al., GenBank accession no. AF508808) is closely related to plasmid p256 [Sørvig et al., *Microbiology* (2005) 151:421-431], whose copy number was estimated to be ~5-10 copies per chromosome for *L. plantarum* NC7. A P30 synthetic promoter was derived from *L. plantarum* rRNA promoters that are known to be among the strongest promoters in lactic acid bacteria (LAB) [Rud et al. *Microbiology* (2005) 152:1011-1019].

The *Lactococcus lactis* ilvD coding region (SEQ ID NO:231) was PCR-amplified from *Lactococcus lactis* subsp *lactis* NCDO2118 genomic DNA with primers 3T-ilvDLI (BamHI) (SEQ ID NO:408) and 5B-ilvDLI (NotI) (SEQ ID NO:409). *L. lactis* subsp *lactis* NCDO2118 genomic DNA was prepared with a Puregene Gentra Kit (QIAGEN, CA). The 1.7 Kbp *L. lactis* ilvD PCR product (ilvDLI) was digested with NotI and treated with the Klenow fragment of DNA polymerase to make blunt ends. The resulting *L. lactis* ilvD coding region fragment was digested with BamHI and gel-purified using a QIAGEN gel extraction kit (QIAGEN, CA). Plasmid pDM1 was digested with ApaLI, treated with the Klenow fragment of DNA polymerase to make blunt ends, and then digested with BamHI. The gel purified *L. lactis* ilvD coding region fragment was ligated into the BamHI and ApaLI (blunt) sites of the plasmid pDM1. The ligation mixture was transformed into *E. coli* Top10 cells (Invitrogen, CA). Transformants were plated for selection on LB chloramphenicol plates. Positive clones were screened by SaiI digestion, giving one fragment with an expected size of 5.3 Kbp. The positive clones were further confirmed by DNA sequencing. The correct clone was named pDM1-ilvD (*L. lactis*).

The *S. mutans* UA159 (ATCC 700610) ilvD coding region from the plasmid pET28a was cloned on the plasmid pDM1. The construction of pET28a containing the *S. mutans* ilvD was described in Example 2. The plasmid pET28a containing the *S. mutans* ilvD was digested with XbaI and NotI, treated with the Klenow fragment of DNA polymerase to make blunt ends, and a 1,759 bp fragment containing the *S. mutans* ilvD coding region was gel-purified. Plasmid pDM1 was digested with BamHI, treated with the Klenow fragment of DNA polymerase to make blunt ends, and then digested with PvuII. The gel purified fragment containing *S. mutans* ilvD coding region was ligated into the BamHI(blunt) and PvuII sites of the plasmid pDM1. The ligation mixture was transformed into *E. coli* Top10 cells (Invitrogen, CA). Transformants were plated for selection on LB chloramphenicol plates. Positive clones were screened by ClaI digestion, giving one fragment with an expected size of 5.5 Kbp. The correct clone was named pDM1-ilvD (*S. mutans*).

Example 5

Measurement of Expressed DHAD Activity in *L. plantarum* PN0512

*L. plantarum* PN0512 was transformed with plasmid pDM1-ilvD (*L. lactis*) or pDM1-ilvD (*S. mutans*) by electroporation. Electro-competent cells were prepared by the following procedure. 5 ml of Lactobacilli MRS medium containing 1% glycine was inoculated with PN0512 cells and grown overnight at 30° C. 100 ml MRS medium with 1% glycine was inoculated with the overnight culture to an OD600=0.1 and grown to an OD600=0.7 at 30° C. Cells were harvested at 3700×g for 8 min at 4° C., washed with 100 ml cold 1 mM $MgCl_2$, centrifuged at 3700×g for 8 min at 4° C., washed with 100 ml cold 30% PEG-1000 (81188, Sigma-Aldrich, St. Louis, Mo.), recentrifuged at 3700×g for 20 min at 4° C., then resuspended in 1 ml cold 30% PEG-1000. 60 µl of electro-competent cells were mixed with ~100 ng plasmid DNA in a cold 1 mm gap electroporation cuvette and electroporated in a BioRad Gene Pulser (Hercules, Calif.) at 1.7 kV, 25 µF, and 400Ω. Cells were resuspended in 1 ml MRS medium containing 500 mM sucrose and 100 mM $MgCl_2$, incubated at 30° C. for 2 hrs, and then plated on MRS medium plates containing 10 µg/ml of chloramphenicol.

*L. plantarum* PN0512 transformants carrying pDM1-ilvD (*L. lactis*) or pDM1-ilvD (*S. mutans*). as well as control transformants with the pDM1 vector alone, were grown overnight in Lactobacilli MRS medium at 30° C. 120 ml of MRS medium supplemented with 100 mM MOPS (pH7.5), 40 µM ferric citrate, 0.5 mM L-cysteine, and 10 µg/ml chloramphenicol was inoculated with overnight culture to an OD600=0.1 in a 125 ml screw cap flask, for each overnight sample. The cultures were anaerobically incubated at 37° C. until reaching an OD600 of 1-2. Cultures were centrifuged at 3700×g for 10 min at 4° C. Pellets were washed with 50 mM potassium phosphate buffer pH 6.2 (6.2 g/L $KH_2PO_4$ and 1.2 g/L $K_2HPO_4$) and re-centrifuged. Pellets were frozen and stored at −80° C. until assayed for DHAD activity. Cell extract samples were assayed for DHAD activity using a dinitrophenylhydrazine based method as described in Example 2. The DHAD activity results are given in Table 7. Specific activity of *L. lactis* DHAD and *S. mutans* DHAD in *L. plantarum* PN0512 showed 0.02 and 0.06 µmol $min^{-1}$ $mg^{-1}$, respectively, while the vector control sample exhibited no detectable activity.

TABLE 7

DHAD activity in *L. plantarum* PN0512.

| Source of DHAD | Plasmid | Specific Activity (µmol $min^{-1}$ $mg^{-1}$) |
|---|---|---|
| Vector control | pDM1 | 0.00 |
| *Lactococcus lactis* subsp *lactis* NCDO2118 | pDM1-ilvD (*L. lactis*) | 0.02 |
| *Streptococcus mutans* UA159 | pDM1-ilvD (*S. mutans*) | 0.06 |

Example 6

Expression of Dihydroxy-Acid Dehydratase from S. mutans in Yeast

The shuttle vector pRS423 FBA ilvD(Strep) (SEQ ID NO:430) was used for the expression of DHAD from *Streptococcus mutans*. This shuttle vector contained an F1 origin of replication (1423 to 1879) for maintenance in *E. coli* and a 2 micron origin (nt 8082 to 9426) for replication in yeast. The vector has an FBA promoter (nt 2111 to 3108; SEQ ID NO:425) and FBA terminator (nt 4861 to 5860). In addition, it carries the His marker (nt 504 to 1163) for selection in yeast and ampicillin resistance marker (nt 7092 to 7949) for selection in *E. coli*. The ilvD coding region (nt 3116 to 4828) from *Streptococcus mutans* UA159 (ATCC 700610) is between the FBA promoter and FBA terminator forming a chimeric gene for expression.

To test the expression of the DHAD from *Streptococcus mutans* in yeast strain BY4741 (known in the art and obtainable from ATCC #201388), the expression vector pRS423 FBA IlvD(Strep) was transformed in combination with empty vector pRS426 into BY4741 cells (obtainable from ATCC, #201388). The transformants were grown on synthetic medium lacking histidine and uracil (Teknova). Growth on liquid medium for assay was carried out by adding 5 ml of an overnight culture into 100 ml medium in a 250 ml flask. The cultures were harvested when they reached 1 to 2 O.D. at 600 nm. The samples were washed with 10 ml of 20 mM Tris (pH 7.5) and then resuspended in 1 ml of the same Tris buffer. The samples were transferred into 2.0 ml tubes containing 0.1 mm silica (Lysing Matrix B, MP biomedicals). The cells were then broken in a bead-beater (BIO101). The supernatant was obtained by centrifugation in a microfuge at 13,000 rpm at 4° C. for 30 minutes. Typically, 0.06 to 0.1 mg of crude extract protein was used in DHAD assay at 37° C. as described by Flint and Emptage (J. Biol. Chem. (1988) 263(8): 3558-64) using dinitrophenylhydrazine. The dehydratase from *Streptococcus mutans* had a specific activity of 0.24 μmol min$^{-1}$ mg$^{-1}$ when expressed in yeast. A control strain containing empty vectors pRS423 and pRS426 had a background of activity in the range of 0.03 to 0.06 μmol min$^{-1}$ mg$^{-1}$.

Example 7

Expression of the IlvD Gene from L. lactis in Yeast

The ilvD coding region from *L. lactis* was amplified with the forward primer IlvD(LI)-F (SEQ ID NO:420) and reverse primer IlvD(LI)-R (SEQ ID NO:421). The amplified fragment was cloned into the shuttle vector pNY13 by gap repair. pNY13 (SEQ ID NO:437) was derived from pRS423. This shuttle vector contained an F1 origin of replication (1423 to 1879) for maintanence in *E. coli* and a 2 micron origin (nt 7537 to 8881) for replication in yeast. The vector has an FBA promoter (nt 2111 to 3110) and FBA terminator (nt 4316 to 5315). In addition, it carries the His marker (nt 504 to 1163) for selection in yeast and Ampicillin resistance marker (nt 6547 to 7404) for selection in *E. coli*.

Positive clones were selected based on amplification with the forward and reverse primers for the ilvD coding region and further confirmed by sequencing. The new construct was designated as pRS423 FBA ilvD (*L. lactis*). This construct was transformed into yeast strain BY4743 (Δ LEU1) (Open Biosystems, Huntsville, Ala.; Catalog #YSC1021-666629) along with the empty vector pRS426 as described in Example 6. The growth and assay of yeast strains containing the expression vector were also carried out according to the procedures as described in Example 6. The dihydroxy-acid dehydratase activity in yeast strains with the *L. lactis* IlvD gene was determined to be in the range of 0.05 to 0.17 μmol min$^{-1}$ mg$^{-1}$. This activity was slightly above the control. Complementation experiments were carried out to investigate the expression of this DHAD and DHADs from other bacteria (example 8).

Example 8

Complementation of Yeast ILV3 Deletion Strain with Bacterial DHADs

The endogenous DHAD enzyme of *S. cerevisiae* is encoded by the ILV3 gene and the protein is targeted to the mitochondrion. Deletion of this gene results in loss of endogenous DHAD activity and provides a test strain where expression of heterologous cytosolic DHAD activity can be readily assessed. Deletion of ILV3 results in an inability of the strain to grow in the absence of branched-chained amino acids. Expression of different bacterial DHADs was assayed by determining their ability to complement the yeast ILV3 deletion strain such that it grows in the absence of branched-chained amino acids.

Expression shuttle vectors containing ilvD gene sequences encoding DHADs from the bacteria listed in Table 8 were constructed. The basic elements of these expression constructs were the same as the pRS423 FBA ilvD(strep) vector described in Example 6. Each of the ilvD coding regions was prepared by PCR as described in Example 2 and cloned to replace the *Streptococcus mutans* ilvD coding region in pRS423 FBA ilvD(Strep) creating the plasmids listed in Table 8. These expression constructs were transformed into the ILV3 deletion strain, BY4741 ilv3::URA3 and was prepared as follows. An ilv3::URA3 disruption cassette was constructed by PCR amplification of the URA3 marker from pRS426 (ATCC No. 77107) with primers "ILV3::URA3 F" and "ILV3::URA3 R", given as SEQ ID NOs: 431 and 432. These primers produced a 1.4 kb URA3 PCR product that contained 70 bp 5' and 3' extensions identical to sequences upstream and downstream of the ILV3 chromosomal locus for homologous recombination. The PCR product was transformed into BY4741 cells (ATCC 201388) using standard genetic techniques (*Methods in Yeast Genetics*, 2005, Cold Spring Harbor Laboratory Press, Cold Spring Harbor, N.Y., pp. 201-202) and resulting transformants were maintained on synthetic complete media lacking uracil and supplemented with 2% glucose at 30° C. Transformants were screened by PCR using primers "ILV3 F Check" and "URA3 REV Check", given as SEQ ID NOs:433 and 434, to verify integration at the correct site and disruption of the endogenous ILV3 locus.

The transformants with bacterial DHADs in Table 8 were selected on plates with yeast synthetic medium lacking histidine. Colonies selected were then patched onto plates lacking valine, leucine and isoleucine. Strains containing the expression vectors listed in Table 8 were able to grow on these plates lacking the branched chain amino acids, while the control strain with the control plasmid did not. This result indicated that DHADs from these bacteria were actively expressed in *S. cerevisiae*.

TABLE 8

Bacterial DHADs tested and Expression vectors

| Organism Source of DHAD | SEQ ID NO. OF DHAD nucleic acid sequence | Vector designation |
|---|---|---|
| *Nitrosomonas europaea* ATCC 19718 | 309 | pRS423 FBA ilvD (europ) |
| *Synechocystis* sp. PCC 6803 | 297 | pRS423 FBA ilvD (Synech) |
| *Streptococcus thermophilus* LMC 18311 | 163 | pRS423 FBA ilvD (thermo) |
| *Ralstonia eutropha* H16 (ATCC 17699) | 406 | pRS423 FBA ilvD (H16) |
| *Lactococcus lactis* | 231 | pRS423 FBA ilvD (*L. lactis*) |

Example 9

Purification and Characterization of DHAD from *Lactococcus lactis* Expressed in *E. coli*

The DHAD from *L. lactis* was purified and characterized. For purification of *L. lactis* DHAD, 14 liters of culture of the *E. coli* Tuner (DE3) strain (Novagen) harboring the pET28a plasmid containing the *L. lactis* ilvD were grown and induced with IPTG. The enzyme was purified by breaking the cells, as described in Example 2, in 120 mls of 50 mM Tris buffer pH 8.0 containing 10 mM $MgCl_2$ (TM8 buffer), centrifuging to remove cell debris, then loading the supernatant of the crude extract on a 5×15 cm Q Sepharose (GE Healthcare) column and eluting the DHAD with an increasing concentration of NaCl in TM8 buffer. The fractions containing the DHAD were pooled, made 1 M in $(NH_4)_2SO_4$ and loaded onto a 2.6×15 cm phenyl-Sepharose column (GE Healthcare) column equilibrated with 1 M $(NH_4)_2SO_4$ in TM8 buffer and eluted with a decreasing gradient of $(NH_4)_2SO_4$. The fractions containing DHAD off the phenyl-Sepharose column were pooled and concentrated to 10 ml. This was loaded onto a 3.5×60 cm Superdex-200 column (GE Healthcare) and eluted with TM8. The fractions containing DHAD activity were pooled, concentrated, and frozen as beads in $N_{2(l)}$ As judged by SDS gels, the purity of the protein eluted from the Superdex-200 column was estimated to be >80%. The activity of the enzyme was assayed at 37° C. as described by Flint et al. (J. Biol. Chem. (1988) 263(8): 3558-64). The specific activity of the purified protein was 64 μmol $min^{-1}$ $mg^{-1}$ at pH 8 and 37° C. The $k_{cat}$ for the purified enzyme was 71 $sec^{-1}$.

Figure 8:
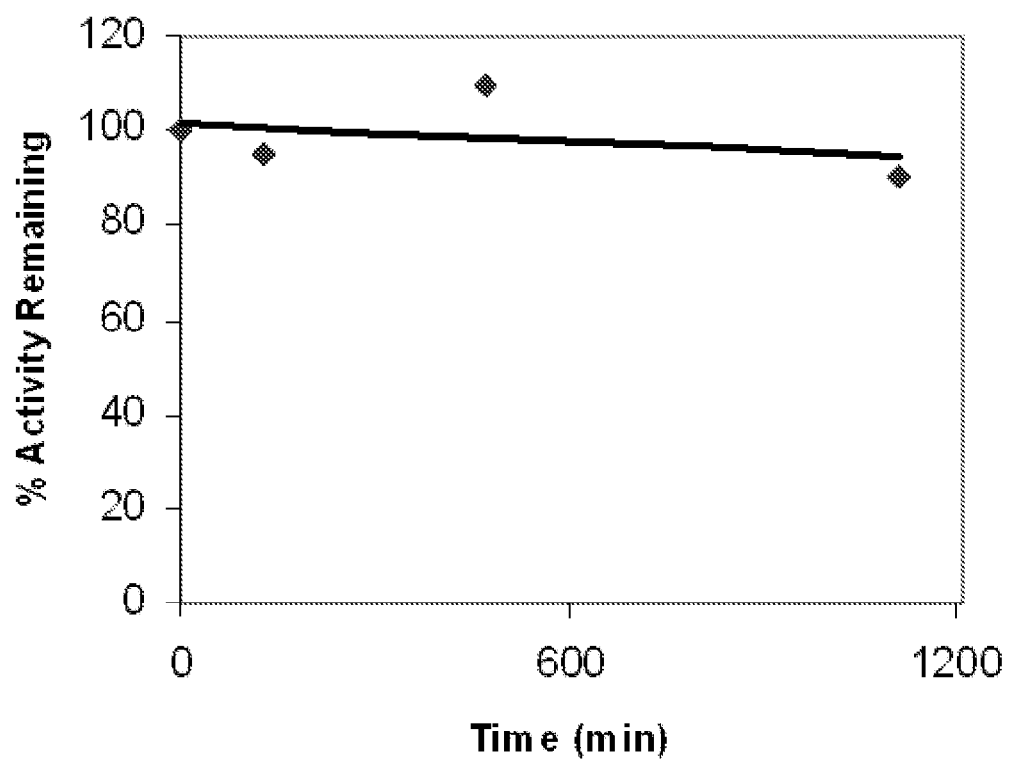
FIG. 8 shows a graph of stability of *L. lactis* DHAD in air.

Stability of the purified DHAD in air was studied by incubating the purified enzyme at 23° C. for various time intervals in the presence of ambient air, followed by an activity assay as described above. The DHAD from *L. lactis* was almost fully active even after 20 hours of incubation in air as shown in FIG. 8.

Figure 9:
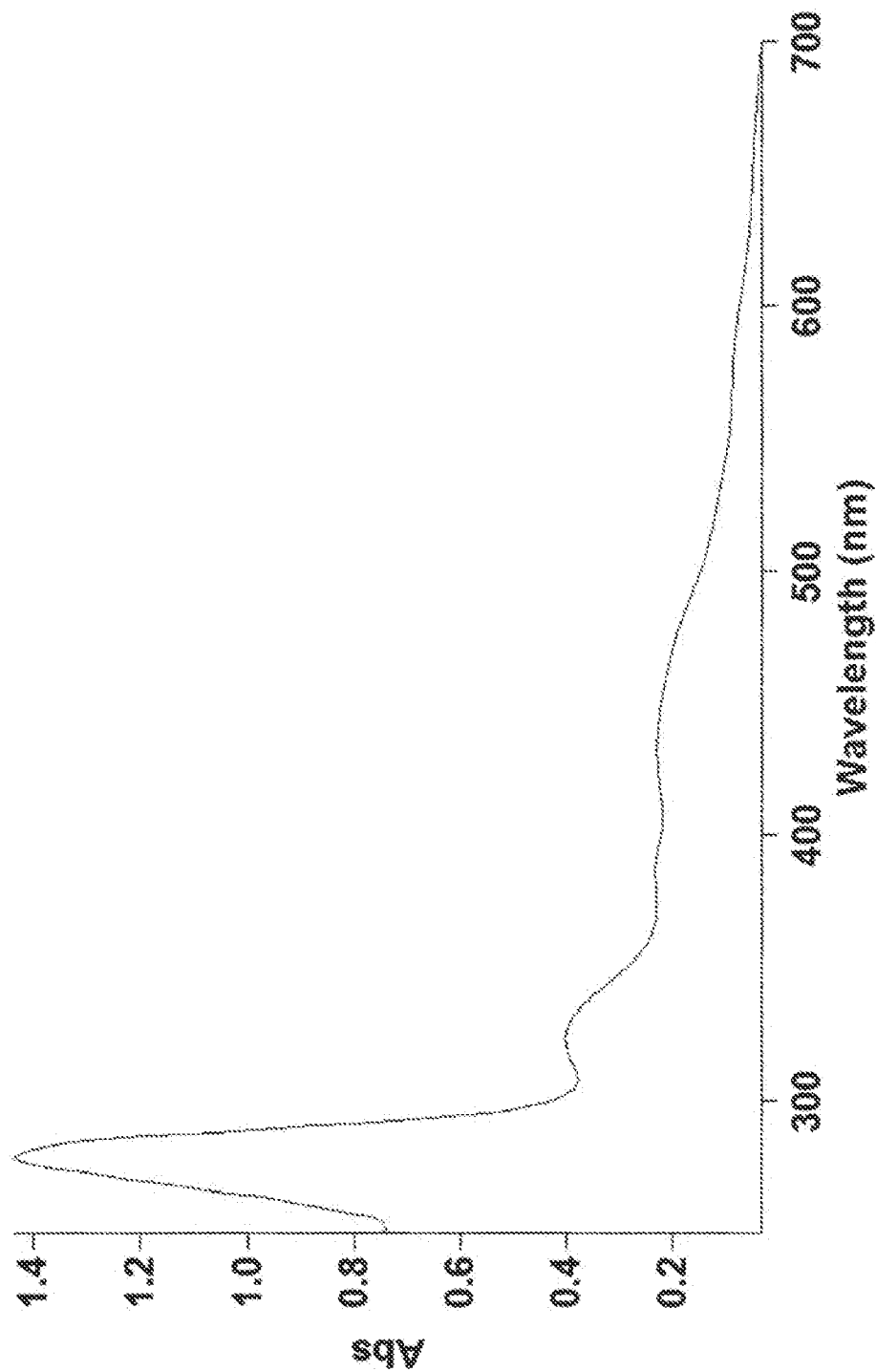
FIG. 9 shows a plot of the UV-visible spectrum of the purified *L. lactis* DHAD.

The UV-visible spectrum of the purified *L. lactis* is shown in FIG. 9. It is characteristic of proteins with [2Fe-2S] clusters.

Example 10

Use of Dihydroxy-Acid Dehydratase to Construct a Pathway for the Production of Isobutanol in Yeast The first three steps of an isobutanol biosynthetic pathway are performed by the enzymes acetolactate synthase, ketol-acid reductoismerase (KARI), and dihydroxy-acid dehydratase. Acetolactate synthase is encoded by alsS. KARI genes are known as ILV5 in yeast or ilvC in bacteria. Once α-ketoisovalerate (KIV) is formed from pyruvate by the reaction of these three enzymes, it can be further converted to isobutanol in yeast by alcohol dehydrogenases.

Vector pLH532 (SEQ ID NO:411) was constructed to express KARI and alsS genes. This vector is derived from the 2 MICRON based vector pHR81. In pLH532 the alsS coding region from *B. subtilis* (nt 14216 to 15931) was under the control of the CUP1 promoter (nt. 15939 to 16386). There were two KARI genes in pLH532: the ilvC coding region from *P. fluorescens* Pf5 (nt. 10192 to 11208) was under the control of the yeast ILV5 promoter (nt. 11200 to 12390), and the yeast ILV5 coding region (nt. 8118-9167) was placed under the control of the FBA promoter (nt. 7454-8110). The selection marker was URA3 (nt. 3390 to 4190).

The yeast host for isobutanol production was BY4741 pdc1::FBAp-alsS-LEU2. This strain was constructed as follows. First, the expression plasmid pRS426-FBAp-alsS was constructed. The 1.7 kb alsS coding region fragment of pRS426::GPD::alsS::CYC was isolated by gel purification following BbvCI and PacI digestion. This plasmid has a chimeric gene containing the GPD promoter (SEQ ID NO:439), the alsS coding region from *Bacillus subtilis* (SEQ ID NO:438), and the CYC1 terminator (SEQ ID NO:440) and was described in Example 17 of US Patent Publication No. US20070092957A1 which is herein incorporated by reference. The ILV5 fragment from plasmid pRS426::FBA::ILV5::CYC, also described in US20070092957 Example 17, was removed by restriction digestion with BbvCI and PacI and the remaining 6.6 kb vector fragment was gel purified. This vector has a chimeric gene containing the FBA promoter (SEQ ID NO:425) and CYC1 terminator bounding the coding region of the ILV5 gene of *S. cerevisiae* (SEQ ID NO:442). These two purified fragments were ligated overnight at 16° C. and transformed into *E. coli* TOP10 chemically competent cells (Invitrogen). Transformants were obtained by plating cells on LB Amp100 medium. Insertion of alsS into the vector was confirmed by restriction digestion pattern and PCR (primers N98SeqF1 and N99SeqR2, SEQ ID NOs:412 and 413).

A pdc1::FBAp-alsS-LEU2 disruption cassette was created by joining the FBAp-alsS segment from pRS426-FBAp-alsS to the LEU2 gene from pRS425 (ATCC No. 77106) by SOE PCR (as described by Horton et al. (1989) Gene 77:61-68) using as template pRS426-FBAp-alsS and pRS425 plasmid DNAs, with Phusion DNA polymerase (New England Biolabs Inc., Beverly, Mass.; catalog no. F-540S) and primers 112590-48A and 112590-30B through D, given as SEQ ID NOs:414, SEQ ID NOs:415, 416, and 417. The outer primers for the SOE PCR (112590-48A and 112590-30D) contained 5' and 3' 50 bp regions homologous to regions upstream and downstream of the PDC1 promoter and terminator. The completed cassette PCR fragment was transformed into BY4741 (ATCC No. 201388) and transformants were maintained on synthetic complete media lacking leucine and supplemented with 2% glucose at 30° C. using standard genetic techniques (*Methods in Yeast Genetics,* 2005, Cold Spring Harbor Laboratory Press, Cold Spring Harbor, N.Y., pp. 201-202). Transformants were screened by PCR using primers 112590-30E and 112590-30F, given as SEQ ID NOs:419 and 418, to verify integration at the PDC1 locus with deletion of the PDC1 coding region. The correct transformants have the genotype: BY4741 pdc1::FBAp-alsS-LEU2.

Figure 7:
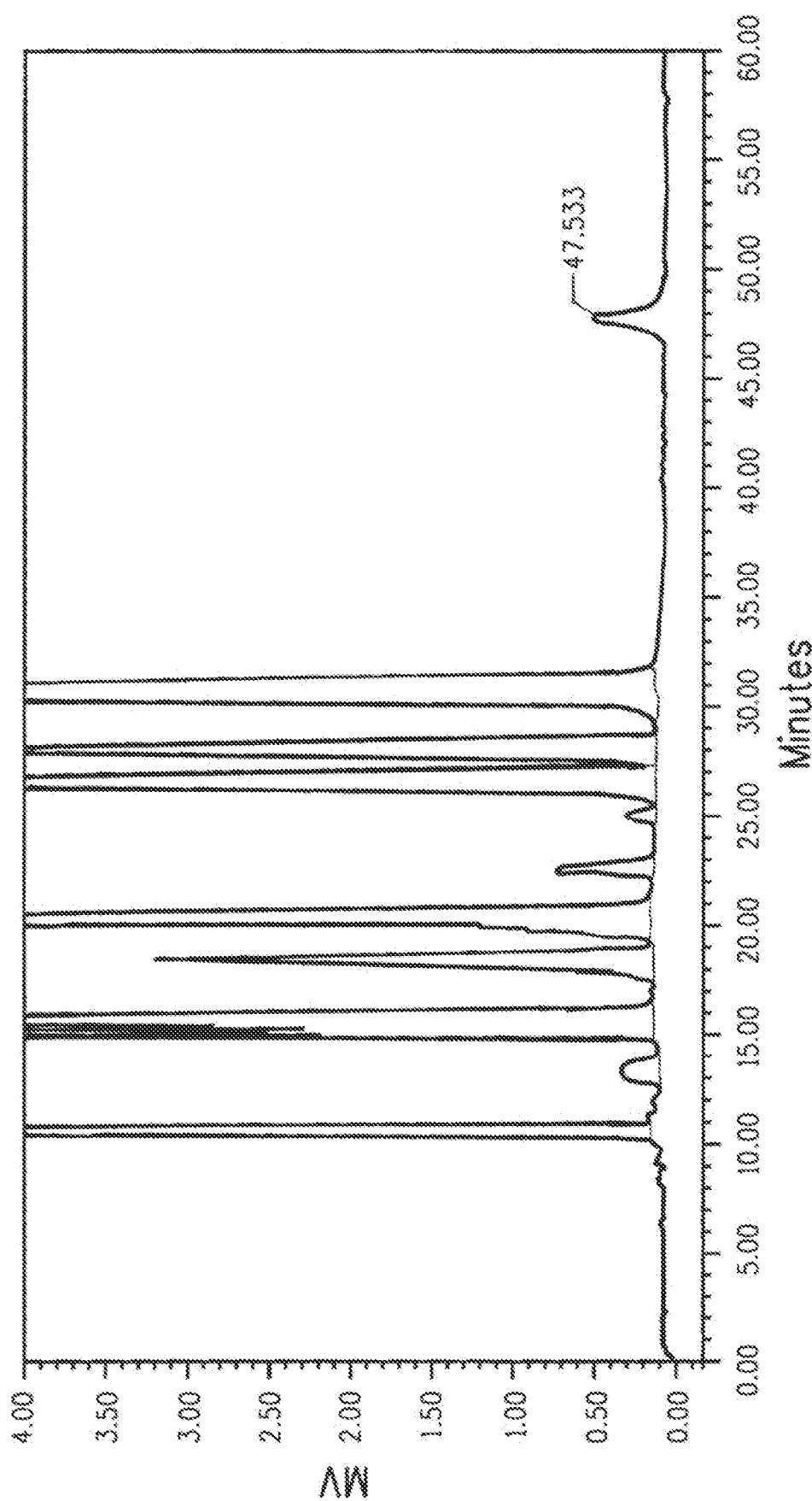
FIG. 7 shows HPLC analysis of an extract of yeast cells that express acetolactate synthase, KARI, and *S. mutans* DHAD genes, with an isobutanol peak at 47.533 minutes.

To test whether the ilvD encoded DHAD from *Streptococcus mutans* could be used for the biosynthesis of isobutanol, the expression vector containing this ilvD, pRS423 FBA ilvD (strep) prepared in Example 6, was co-transformed with vector pLH532 into yeast strain BY4741 pdc1::FBAp-alsS-LEU2. Competent cell preparation, transformation, and growth medium for selection of the transformants were the same as described in Example 6. Selected colonies were grown under oxygen-limiting conditions in 15 ml of medium in 20 ml serum bottles with stoppers. The bottles were incubated at 30° C. in a shaker with a constant speed of 225 rotations per minute. After 48 hours of incubation, the samples were analyzed with HPLC for the presence of isobutanol. Result from the HPLC analysis is shown in FIG. 7. The presence of isobutanol was indicated by a peak with a retention time of 47.533 min. This result showed that expression of the ilvD gene from *Streptococcus mutans*, along with expression of alsS and KARI genes, led to the production of isobutanol in yeast.

Example 11

Query of Updated Databases to Identify Additional [2Fe-2S] Dihydroxy-Acid Dehydratases A later second query of the updated public database was performed to discover newly sequenced [2Fe-2S] dihydroxy-acid dehydratases. At the 95% identity cutoff, an initial set of 1425 sequences was generated from a database query as described in Example 1, "Phylogenetic analysis". Multiple sequence alignments were then executed with ClustalW as described in Example 1. Sequences were subsequently analyzed for the following conserved residues at the corresponding positions in the *S. mutans* DHAD: cysteines at positions 56, 129, and 201, aspartic acid at position 88, arginine or asparagine at position 142, asparagine at position 208, and leucine at position 454. In a addition to the original set of 193, 88 novel [2Fe-2S] dihydroxy-acid dehydratases from bacteria were identified and are listed in Table 2b.

TABLE 1

| | |
|---|---|
| HMMER2.0 [2.2 g] | Program name and version |
| NAME dhad_for_hmm | Name of the input sequence alignment file |
| LENG 564 | Length of the alignment: include indels |
| ALPH Amino | Type of residues |
| MAP yes | Map of the match states to the columns of the alignment |
| COM/app/public/hmmer/current/bin/ | Commands used to generate the file: this one means that |
| hmmbuild-F dhad-exp_hmm dhad_for_hmm.aln | hmmbuild (default parameters) was applied to the alignment file |
| COM/app/public/hmmer/current/bin/hmmcalibrate dhad-exp_hmm | Commands used to generate the file: this one means that |
| | hmmcalibrate (default parameters) was applied to the hmm profile |
| NSEQ 8 | Number of sequences in the alignment file |
| DATE Tue Jun 3 10:48:24 2008 | When was the file generated |
| XT −8455 −4 −1000 −1000 −8455 −4 −8455 −4 | |
| NULT −4 −8455 | The transition probability distribution for the null model (single G state). |
| NULE 595 −1558 85 338 −294 453 −1158 197 249 902 −1085 −142 −21 −313 45 531 201 384 −1998 | The symbol emission probability distribution for the null model (G state); consists of K (e.g. 4 or 20) integers. The null probability used to convert these back to model probabilities is 1/K. |
| EVD −499.650970 0.086142 | The extreme value distribution parameters $\mu$ and lambda respectively; both floating point values. Lambda is positive and nonzero. These values are set when the model is calibrated with hmmcalibrate. |

| HMM | A | C | D | E | F | G | H | I | K | L | M | N | P | Q | R | S | T | V | W | Y | Position in alignment |
|---|---|---|---|---|---|---|---|---|---|---|---|---|---|---|---|---|---|---|---|---|---|
| | m -> m | m -> i | m -> d | i -> m | i -> i | d -> m | d -> d | b -> m | m -> e | | | | | | | | | | | | |
| | −538 | * | −1684 | | | | | | | | | | | | | | | | | | |
| 1(M) | −233 | −1296 | 99 | 1223 | −1477 | −1132 | 89 | −1122 | 420 | −1248 | 1757 | 1553 | −1296 | 464 | −24 | −190 | −188 | −838 | −1578 | −985 | 6 |
| - | −149 | −500 | 233 | 43 | −381 | 399 | 106 | −626 | 210 | −466 | −720 | 275 | 394 | 45 | 96 | 359 | 117 | −369 | −294 | −249 | |
| - | −29 | −6203 | −7245 | −894 | −1115 | −701 | −1378 | −538 | * | | | | | | | | | | | | |
| 2(E) | −220 | −1288 | 232 | 1356 | −1807 | 1016 | −70 | −1474 | 190 | −1584 | −775 | 132 | −1298 | 300 | −282 | −183 | 1140 | −1092 | −1872 | −1262 | 7 |
| - | −149 | −500 | 233 | 43 | −381 | 399 | 106 | −626 | 210 | −466 | −720 | 275 | 394 | 45 | 96 | 359 | 117 | −369 | −294 | −249 | |
| - | −29 | −6203 | −7245 | −894 | −1115 | −701 | −1378 | * | * | | | | | | | | | | | | |
| 3(K) | −448 | −1932 | −1558 | 658 | −2220 | −1048 | 40 | −1983 | 1569 | −1938 | −1091 | 1558 | −1319 | 450 | −193 | −278 | −419 | −1552 | −2121 | −1397 | 8 |
| - | −149 | −500 | 233 | 43 | −381 | 399 | 106 | −626 | 210 | −466 | −720 | 275 | 394 | 45 | 96 | 359 | 117 | −369 | −294 | −249 | |
| - | −29 | −6203 | −7245 | −894 | −1115 | −701 | −1378 | * | * | | | | | | | | | | | | |
| 4(V) | −404 | −498 | −1497 | −939 | −588 | −1810 | −640 | 1591 | 914 | −127 | 335 | −962 | −1866 | −562 | −767 | −868 | −357 | 1720 | −1169 | −763 | 9 |
| - | −149 | −500 | 233 | 43 | −381 | 399 | 106 | −626 | 210 | −466 | −720 | 275 | 394 | 45 | 96 | 359 | 117 | −369 | −294 | −249 | |
| - | −29 | −6203 | −7245 | −894 | −1115 | −701 | −1378 | * | * | | | | | | | | | | | | |
| 5(E) | −265 | −1340 | −52 | 1376 | −1572 | −1189 | 113 | −1125 | 1345 | −1287 | −496 | 99 | −1321 | 505 | 198 | −218 | −205 | 597 | −1598 | −1032 | 10 |
| - | −149 | −500 | 233 | 43 | −381 | 399 | 106 | −626 | 210 | −466 | −720 | 275 | 394 | 45 | 96 | 359 | 117 | −369 | −294 | −249 | |
| - | −29 | −6203 | −7245 | −894 | −1115 | −701 | −1378 | * | * | | | | | | | | | | | | |
| 6(S) | −256 | −397 | −1014 | −830 | −1841 | −646 | −862 | −1443 | −767 | −1740 | −963 | −568 | −1249 | −651 | −1007 | 2267 | 1586 | −862 | −2080 | −1672 | 11 |
| - | −149 | −500 | 233 | 43 | −381 | 399 | 106 | −626 | −210 | −466 | −720 | 275 | 394 | 45 | 96 | 359 | 117 | −369 | −294 | −249 | |
| - | −29 | −6203 | −7245 | −894 | −1115 | −701 | −1378 | * | * | | | | | | | | | | | | |
| 7(M) | −990 | −889 | −2630 | 157 | −513 | −2514 | −1346 | 1309 | −1767 | 820 | 3683 | −1898 | −2491 | −1496 | −1799 | −1589 | −925 | 150 | −1336 | −1041 | 12 |
| - | −149 | −500 | −233 | 43 | −381 | 399 | 106 | −626 | 210 | −466 | −720 | 275 | 394 | 45 | 96 | 359 | 117 | −369 | −294 | −249 | |

TABLE 1-continued

| | | | | | | | | | | | | | | | | | | | | | |
|---|---|---|---|---|---|---|---|---|---|---|---|---|---|---|---|---|---|---|---|---|---|
| - | | -16 | -7108 | -8150 | -894 | -1115 | -701 | -1378 | * | * | | | | | | | | | | | | |
| 8(E) | 588 | -1875 | -194 | 1536 | -2188 | -1373 | -59 | -1931 | 957 | -1890 | -977 | 904 | 292 | 393 | -162 | 483 | -372 | -1495 | -2070 | -1391 | 13 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | | -16 | -7108 | -8150 | -894 | -1115 | -701 | -1378 | * | * | | | | | | | | | | | | |
| 9(N) | -514 | -1116 | 1207 | -315 | 447 | -1650 | -304 | -778 | -224 | 825 | -277 | 1457 | -1738 | -123 | -618 | -627 | -454 | -603 | -1186 | 763 | 14 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 10(N) | -815 | -1190 | -1360 | -922 | -904 | -1967 | -797 | -442 | -670 | 381 | 1700 | 3009 | -2099 | -654 | -934 | -1051 | -791 | -445 | -1490 | -979 | 15 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 11(K) | -1530 | -2498 | -1722 | -855 | -3141 | -2246 | -428 | -2627 | 2828 | -2404 | -1656 | -927 | 662 | -2 | 2047 | -1421 | -1337 | -2324 | -2357 | -2081 | 16 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 12(Y) | -872 | -1887 | -861 | -290 | -1369 | -1801 | 1662 | -1797 | 325 | -1793 | -1031 | 893 | -1876 | 56 | 2219 | -812 | -780 | -1514 | -1565 | 2287 | 17 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 13(S) | -830 | -1586 | -1471 | -1099 | -2717 | -1642 | -1010 | -2479 | -266 | -2518 | -1746 | -1065 | -2069 | -676 | 1822 | 2748 | -1000 | -1950 | -2597 | -2189 | 18 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 14(Q) | -851 | -2131 | -775 | -153 | -2554 | -1735 | -211 | -2205 | 1908 | -2094 | -1244 | -386 | -1802 | 2254 | 974 | 1001 | -747 | -1819 | -2181 | -1667 | 19 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 15(T) | -405 | -1258 | -618 | -100 | -1490 | -1466 | 1158 | -1121 | 1 | 1299 | -514 | 578 | -1607 | 65 | -433 | 960 | 1849 | 343 | -1677 | -1143 | 20 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |

| | | | | | | | | | | | | | | | | | | | | | |
|---|---|---|---|---|---|---|---|---|---|---|---|---|---|---|---|---|---|---|---|---|---|
| 16(I) | -1772 | -1325 | -4307 | -3877 | -1405 | -3993 | -3383 | 2935 | -3705 | 820 | -217 | -3632 | -3761 | -3400 | -3682 | -3260 | -1742 | 2033 | -2838 | -2525 | 21 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | | -16 | -7108 | -8150 | -894 | -1115 | -701 | -1378 | * | * | | | | | | | | | | | | |
| 17(T) | -1018 | -1329 | -2004 | -1771 | -409 | -1993 | -1000 | -1256 | -1512 | -1464 | -966 | -1543 | -2367 | -1428 | -1638 | -1257 | 3050 | -1090 | -1012 | 2448 | 22 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 18(Q) | -1509 | -3056 | 1970 | 44 | -3310 | -1666 | -896 | -3242 | -877 | -3158 | -2439 | -322 | -2123 | 3562 | -1493 | -1259 | -1550 | -2779 | -3260 | -2446 | 23 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 19(D) | -1006 | -2199 | 2378 | -88 | -3159 | 1997 | -936 | -2974 | -948 | -2977 | -2174 | -382 | -1960 | -589 | -1571 | 1295 | -1157 | -2369 | -3178 | -2430 | 24 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 20(M) | 445 | -796 | -1082 | -521 | -841 | -1643 | -412 | -403 | -370 | -692 | 2213 | -646 | 536 | 1166 | -698 | -630 | 660 | 831 | -1204 | -767 | 25 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 21(Q) | 741 | -990 | -1025 | -507 | -1249 | -1551 | -519 | -720 | -357 | -1062 | -345 | -635 | -1739 | 1770 | -713 | -589 | 1576 | 1129 | -1559 | -1097 | 26 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 22(R) | -1753 | -2648 | -2072 | -1047 | -3365 | -2405 | -452 | -2782 | 1989 | -2495 | -1773 | -1062 | -2379 | 2402 | 2643 | -1629 | -1506 | -2504 | -2397 | -2190 | 27 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 23(S) | -330 | -1010 | -1820 | -1628 | -2778 | -1229 | -1652 | -2481 | -1592 | -2691 | -1841 | -1273 | 2130 | -1426 | -1834 | 2449 | 1034 | -1716 | -2961 | -2594 | 28 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 24(P) | 1882 | -1119 | -2231 | -2302 | -3062 | -1360 | -2209 | -2710 | -2339 | -3013 | -2243 | -1676 | 3304 | -2117 | -2409 | -742 | -918 | -1916 | -3263 | -3022 | 29 |
| - | | -149 | -500 | 233 | 43 | -381 | 399 | 106 | -626 | 210 | -466 | -720 | 275 | 394 | 45 | 96 | 359 | 117 | -369 | -294 | -249 | |
| - | | -16 | -7108 | -8150 | -894 | -1115 | -701 | -1378 | * | * | | | | | | | | | | | | |
| 25(N) | 969 | -1230 | -1066 | -915 | -2593 | -1313 | -1196 | -2242 | -1033 | -2447 | -1626 | 3197 | -1850 | -898 | -1392 | -582 | 1155 | -1644 | -2736 | -2256 | 30 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 26(R) | -1847 | -2640 | -2014 | -1161 | -3282 | -2428 | -579 | -2818 | 687 | -2553 | -1869 | -1165 | -2462 | 2447 | 3181 | -1746 | -1630 | -2555 | -2447 | -2228 | 31 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 27(A) | 3048 | -932 | -2480 | -2533 | -3075 | -1200 | -2274 | -2765 | -2501 | -3071 | -2221 | -1658 | -1948 | -2205 | -2512 | 1225 | -739 | -1842 | -3322 | -3078 | 32 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 28(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 33 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 29(Y) | -1674 | -1506 | -2863 | -2464 | 596 | -2872 | 2251 | -972 | -2024 | 2197 | -552 | -1986 | -2876 | -1739 | -1988 | -1987 | -1601 | -1002 | -95 | 2332 | 34 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 30(Y) | -2013 | -2305 | -2428 | -1781 | -328 | -2709 | -654 | -2240 | -258 | -2064 | -1626 | -1631 | -2788 | -899 | 2789 | -2017 | -1896 | -2130 | -857 | 3434 | 35 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 31(A) | 2822 | -1031 | -2418 | -2539 | -3226 | 1898 | -2364 | -2941 | -2626 | -3229 | -2379 | -1722 | -2026 | -2302 | -2634 | -654 | -848 | -1983 | -3415 | -3226 | 36 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 32(I) | -1247 | -941 | -3569 | -3039 | -1082 | -3101 | -2185 | 2227 | -2763 | 766 | -76 | -2700 | -3050 | -2469 | -2697 | -2253 | 1322 | 1974 | -1988 | -1633 | 37 |
| - | | -149 | -500 | 233 | 43 | -381 | 399 | 106 | -626 | 210 | -466 | -720 | 275 | 394 | 45 | 96 | 359 | 117 | -369 | -294 | -249 | |
| - | | -16 | -7108 | -8150 | -894 | -1115 | -701 | -1378 | * | * | | | | | | | | | | | | |
| 33(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 38 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 34(F) | -1511 | -1236 | -3511 | -3017 | 2747 | -2982 | -1069 | -260 | -2651 | 992 | 2737 | -2407 | -2904 | -2088 | -2418 | -2099 | -1434 | -489 | -537 | 2056 | 39 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 35(Q) | -576 | -1869 | -401 | 92 | -2232 | -831 | -173 | -1930 | -1505 | -1913 | -1042 | -186 | -1620 | 1653 | 51 | -482 | 1346 | -1534 | -2098 | -1490 | 40 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 36(D) | -1352 | -3066 | 3028 | 1349 | -3303 | -1566 | -724 | -3141 | 1155 | -3043 | -2267 | -165 | -1991 | -354 | -1350 | -1086 | -1368 | -2659 | -3221 | -2356 | 41 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 37(E) | -1507 | -3288 | 2042 | 2762 | -3520 | 515 | -853 | -3401 | -981 | -3296 | -2566 | -182 | -2064 | -503 | -1753 | -1209 | -1553 | -2895 | -3486 | -2547 | 42 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 38(D) | -1445 | -2778 | 3529 | -53 | -3524 | -1590 | -1129 | -3476 | -1367 | -3459 | -2774 | -396 | -2156 | -825 | -2122 | 554 | -1609 | -2880 | -3582 | -2717 | 43 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 39(F) | -2658 | -2176 | -4213 | -4000 | 3815 | -3933 | -1352 | -531 | -3638 | 1121 | -19 | -3184 | -3709 | -2820 | -3296 | -3219 | -2579 | -1037 | -601 | 403 | 44 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 40(D) | -684 | -2193 | 1738 | 1460 | -2494 | -1437 | -249 | -2257 | 1694 | -2199 | -1308 | -62 | -1637 | 185 | -450 | -531 | 633 | -1808 | -2374 | -1657 | 45 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 41(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 46 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 42(P) | 1882 | -1119 | -2231 | -2302 | -3062 | -1360 | -2209 | -2710 | -2339 | -3013 | -2243 | -1676 | 3304 | -2117 | -2409 | -742 | -918 | -1916 | -3263 | -3022 | 47 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 43(I) | -1006 | -992 | -2347 | -1784 | -650 | -2452 | -1256 | 2372 | -1386 | 77 | 2213 | -1720 | -2455 | 2030 | -1490 | -1528 | -946 | 106 | -1441 | -1111 | 48 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 44(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 49 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 45(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 50 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 46(I) | -1759 | -1303 | -4330 | -3968 | -1751 | -4051 | -3743 | 3027 | -3837 | -597 | -528 | -3729 | -3875 | -3688 | -3910 | -3369 | -1751 | 2438 | -3259 | -2819 | 51 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 47(V) | 1736 | -1012 | -3546 | -3078 | -1377 | -3073 | -2434 | -2052 | -2843 | -608 | -331 | -2754 | -3122 | -2619 | -2855 | -2270 | -1277 | 2193 | -2333 | -1941 | 52 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 48(N) | -686 | -1511 | -702 | -806 | -2927 | -1386 | -1339 | -2841 | -1264 | -2950 | -2137 | 2702 | -1979 | -1062 | -1648 | 2444 | -971 | -2105 | -3054 | -2475 | 53 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 49(M) | -411 | -857 | -1800 | -1434 | -1528 | 1914 | -1202 | -1029 | -1247 | -1347 | 2980 | -1217 | -1912 | -1119 | -1444 | -676 | 1550 | -767 | -1922 | -1539 | 54 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 50(W) | -782 | -1258 | 793 | -683 | 1193 | 346 | 2051 | -932 | -556 | -1092 | -441 | -798 | -1993 | -426 | -909 | -904 | -720 | -779 | 3163 | 1546 | 55 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 51(W) | 1009 | -798 | -1470 | -935 | -463 | -1773 | -545 | -460 | -751 | -736 | -66 | -943 | -1904 | -606 | -1002 | 1604 | -507 | -322 | 2535 | 1521 | 56 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 52(D) | -1137 | -2711 | 2125 | 1647 | -2995 | -1523 | -617 | -2786 | -528 | -2743 | -1933 | -150 | -1897 | -234 | -1165 | -924 | 2117 | -2331 | -2948 | -2141 | 57 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 53(I) | -599 | -1102 | -1031 | -829 | -1522 | 1429 | -927 | 2119 | -880 | -1369 | -699 | 1692 | -1938 | -759 | -1188 | -799 | -698 | -689 | -1887 | -1419 | 58 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 54(T) | -666 | -1412 | -954 | -984 | -2702 | -1428 | -1357 | -2418 | -1208 | -2650 | -1886 | 2293 | -2000 | -1101 | -1519 | -787 | 2967 | -1835 | -2866 | -2360 | 59 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 55(P) | -632 | -1230 | -2074 | -2144 | -2996 | -1453 | -2116 | -2631 | -2128 | -2928 | -2213 | -1658 | 3610 | -2006 | -2221 | -852 | 1302 | -1931 | -3185 | -2917 | 60 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | | |
|---|---|---|---|---|---|---|---|---|---|---|---|---|---|---|---|---|---|---|---|---|---|
| 56(C) | -2476 | 5735 | -4102 | -4358 | -3712 | -2763 | -3545 | -3518 | -4168 | -3859 | -3569 | -3631 | -3363 | -4030 | -3832 | -2793 | -2860 | -3158 | -3464 | -3718 | 61 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 57(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 62 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 58(M) | 672 | -918 | -3119 | -2578 | -742 | -2668 | -1734 | 1807 | -2263 | 16 | 3713 | -2271 | -2704 | -1960 | -2216 | -1806 | -1058 | 493 | -1612 | -1306 | 63 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 59(H) | -1525 | -2164 | -1235 | -1346 | -2509 | 2296 | 4235 | -3172 | -1516 | -3178 | -2523 | -1448 | -2541 | -1520 | -1760 | -1591 | -1741 | -2656 | -2681 | -2065 | 64 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 60(L) | -2478 | -2009 | -4717 | -4196 | -568 | -4424 | -3262 | 1334 | -3887 | 2824 | 604 | -4085 | -3872 | -3088 | -3590 | -3717 | -2380 | -199 | -2217 | -2207 | 65 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 61(H) | -682 | -2191 | 1015 | 275 | -2485 | 396 | 2379 | -2251 | 62 | -2197 | -1307 | 1826 | -1636 | 1527 | -480 | -529 | -641 | -1803 | -2375 | -1654 | 66 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 62(D) | -575 | -1920 | 1979 | 184 | -2299 | 94 | -242 | -2029 | 114 | -2023 | -1144 | -120 | -1608 | 186 | 1063 | -469 | 1413 | -1605 | -2229 | -1561 | 67 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 63(L) | -2618 | -2139 | -4597 | -4163 | 2144 | -4285 | -2334 | -83 | -3854 | 2690 | 538 | -3771 | -3806 | -2950 | -3488 | -3563 | -2505 | -751 | -1442 | -808 | 68 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 64(A) | 2657 | -1033 | -2408 | -2532 | -3233 | 2193 | -2364 | -2950 | -2626 | -3237 | -2386 | -1719 | -2027 | -2301 | -2635 | -655 | -850 | -1988 | -3420 | -3231 | 69 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 65(K) | -443 | -1857 | 958 | 270 | -2158 | -1393 | -66 | -1890 | 1839 | -442 | -957 | -36 | -1499 | 1204 | -132 | 616 | -382 | -1469 | -2048 | -1383 | 70 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 66(C) | 605 | 1553 | 739 | -17 | -1374 | -1488 | -182 | 260 | 969 | -203 | -397 | -263 | -1573 | 159 | 691 | -426 | -331 | -761 | -1567 | -1032 | 71 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 67(A) | 2327 | -956 | -3193 | -2728 | -1289 | -2677 | -2114 | 1664 | -2485 | -601 | -288 | -2403 | -2839 | -2263 | -2523 | -1871 | -1126 | 1617 | -2143 | -1765 | 72 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 68(K) | -532 | -1656 | -490 | 1321 | -1891 | -1527 | -172 | -124 | 2206 | -1591 | -782 | -223 | -1619 | 237 | -106 | -482 | -464 | -98 | -1904 | -1326 | 73 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 69(H) | 384 | -1854 | 936 | 889 | -2165 | -1363 | 1498 | -1909 | 1111 | -1866 | -948 | 1091 | -1464 | 421 | -131 | -284 | -342 | -69 | -2043 | -1364 | 74 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 70(G) | 1823 | -932 | -2330 | -2313 | -3120 | 2511 | -2158 | -2865 | -2331 | -3098 | -2209 | -1563 | -1912 | -2032 | -2419 | 1138 | -706 | -1883 | -3328 | -3077 | 75 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 71(V) | -1760 | -1333 | -4244 | -3789 | -1262 | -3902 | -3190 | 1495 | -3588 | 1270 | -96 | -3536 | -3677 | -3238 | -3534 | -3148 | -1725 | 2865 | -2654 | -2373 | 76 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 72(W) | -1054 | -2172 | -1112 | -403 | -2566 | -1917 | -286 | -2196 | 2516 | -2095 | -1292 | 1183 | -1958 | 140 | 1333 | -959 | -922 | -1867 | 2591 | -1720 | 77 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 73(D) | 611 | -1995 | 1525 | 937 | -2295 | -1400 | -148 | -2043 | 211 | -2006 | -1106 | -37 | -1553 | 1420 | -312 | -408 | 1235 | -1609 | -2193 | -1499 | 78 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 74(A) | 2716 | -902 | -2380 | -2205 | -2799 | -1197 | -1975 | -2459 | -2081 | -2736 | -1895 | -1520 | -1895 | -1844 | -2201 | 1191 | 1299 | -1699 | -3045 | -2758 | 79 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 75(G) | -1709 | -2833 | 2424 | -409 | -3781 | 2819 | -1457 | -3777 | -1728 | -3733 | -3076 | -739 | -2389 | -1180 | -2441 | -1557 | -1893 | -3158 | -3660 | -3038 | 80 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 76(A) | 2529 | -1119 | -2614 | -2330 | -1245 | -1983 | -1829 | -377 | -2042 | 1435 | -341 | -1937 | -2411 | -1873 | -2088 | -1266 | -1059 | -397 | -2063 | -1713 | 82 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 77(W) | -472 | -361 | -2421 | -1812 | -298 | -1979 | -826 | 1164 | -1486 | -143 | 2485 | 873 | -2028 | -1185 | -1426 | -1048 | -412 | 1116 | 2999 | -454 | 83 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 78(P) | -1198 | -1737 | -2187 | -2394 | -3665 | 2006 | -2550 | -3630 | -2743 | -3756 | -3008 | -2052 | 3474 | -2495 | -2835 | -1401 | -1593 | -2736 | -3511 | -3519 | 84 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 79(Q) | -999 | -1075 | -2106 | -1568 | -726 | -2370 | -1175 | 83 | -1185 | 1373 | 218 | -1566 | -2400 | 2445 | -1340 | -1445 | -946 | 1441 | -1501 | -1146 | 85 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 80(Q) | -885 | -779 | -2609 | -2018 | -481 | -2414 | -1253 | 1645 | -1736 | 799 | 1924 | -1827 | -2405 | 2262 | -1752 | -1484 | -821 | -802 | -1240 | -935 | 86 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 81(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 87 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 82(G) | -998 | -2100 | -120 | -175 | -2567 | 2528 | 2174 | -2558 | -587 | -2583 | -1806 | 1422 | -1966 | -461 | -1038 | -925 | -1088 | -2095 | -2657 | -1948 | 88 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 83(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 89 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 84(I) | -1286 | -1279 | -2907 | -2683 | -1446 | -2549 | -2198 | 3290 | -2407 | -726 | -534 | -2386 | 1172 | -2299 | -2437 | -1895 | -1392 | 283 | -2302 | -1913 | 90 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 85(T) | -493 | -1105 | -2189 | -2267 | -3101 | 1880 | -2196 | -2791 | -2334 | -3081 | -2269 | -1649 | -2058 | -2099 | -2410 | -719 | 3135 | -1948 | -3282 | -3046 | 91 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 86(V) | -1750 | -1296 | -4319 | -3957 | -1765 | -4038 | -3733 | 2364 | -3826 | -619 | -543 | -3716 | -3869 | -3685 | -3902 | -3354 | -1743 | 3012 | -3265 | -2817 | 92 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 87(S) | 923 | -962 | -2348 | -2422 | -3132 | -1207 | -2248 | -2850 | -2440 | -3140 | -2285 | -1624 | -1954 | -2158 | -2477 | 3171 | -758 | -1896 | -3362 | -3103 | 93 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 88(D) | -2784 | -3432 | 4016 | -1200 | -4140 | -2465 | -2197 | -4505 | -2621 | -4365 | -3956 | -1551 | -3014 | -2039 | -3232 | -2593 | -2938 | -4046 | -3710 | -3552 | 94 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 89(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 95 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 90(I) | -1880 | -1493 | -4193 | -3724 | -953 | -3837 | -2980 | 3251 | -3420 | 257 | 2372 | -3485 | -3608 | -3005 | -3310 | -3087 | -1840 | 617 | -2373 | -2155 | 96 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 91(S) | 2150 | -939 | -2407 | -2415 | -3075 | -1197 | -2205 | -2781 | -2384 | -3065 | -2205 | -1613 | -1936 | -2105 | -2436 | 2652 | -729 | -1850 | -3306 | -3049 | 97 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 92(M) | -979 | -1455 | -1242 | -1122 | -1434 | -1860 | -1131 | -1171 | -974 | -1285 | 4091 | 2176 | -2226 | -1017 | -1187 | -1166 | -1086 | -1063 | -1929 | -1345 | 98 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 93(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 99 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 94(T) | -959 | 1691 | -1249 | -949 | -2563 | -1747 | -929 | -2093 | 1282 | -2263 | -1554 | -995 | -2115 | -600 | -354 | -1037 | 3152 | -1726 | -2494 | -2098 | 100 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 95(E) | -572 | -1860 | -208 | 2213 | -2107 | -1461 | -191 | -1808 | 199 | -116 | -983 | -127 | 318 | 1199 | -269 | -475 | -517 | -1448 | -2078 | -1441 | 101 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 96(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 102 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 97(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 103 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 98(R) | -2097 | -2786 | -2688 | -1415 | -3622 | -2625 | -555 | -2964 | 2586 | -2627 | -1957 | -1318 | -2577 | -137 | 3015 | -1979 | -1791 | -2732 | -2469 | -2363 | 104 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 99(Y) | -3615 | -2706 | -4169 | -4413 | 2626 | -4044 | -396 | -2535 | -3993 | -1939 | -1985 | -2747 | -3930 | -2852 | -3446 | -3296 | -3494 | -2686 | 347 | 4252 | 105 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 100(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 106 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 101(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 107 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 102(V) | -1381 | -1065 | -3714 | -3252 | -1453 | -3300 | -2646 | 1872 | -3023 | -615 | -373 | -2949 | -3287 | -2816 | -3039 | -2506 | 1346 | 2750 | -2489 | -2087 | 108 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 103(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 109 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 104(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 110 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 105(E) | -1719 | -3572 | 2596 | 2779 | -3767 | -1632 | -993 | -3700 | -1241 | -3578 | -2920 | -234 | -2167 | -666 | -2090 | -1380 | -1789 | -3182 | -3742 | -2756 | 111 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 106(V) | -1746 | -1296 | -4308 | -3946 | -1757 | -4020 | -3712 | 2190 | -3811 | -614 | -539 | -3702 | -3858 | -3667 | -3884 | -3336 | -1740 | 3098 | -3250 | -2803 | 112 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 107(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 113 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 108(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 114 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 109(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 115 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 110(S) | -352 | 2942 | -2955 | -2957 | -2876 | -1254 | -2382 | -2573 | -2692 | -2927 | -2128 | -1827 | -2001 | -2405 | -2607 | 3103 | -778 | -1757 | -3171 | -2911 | 116 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 111(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 117 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 112(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 118 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 113(T) | 1556 | -936 | -2493 | -2457 | -2805 | -1256 | -2159 | -2210 | -2319 | -2681 | -1932 | -1656 | -1974 | -2089 | -2352 | -598 | 3235 | -1547 | -3111 | -2847 | 119 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 114(C) | 1784 | 2119 | -2013 | -1532 | -1093 | -1580 | -1089 | -436 | -1322 | -937 | -273 | 1093 | -1932 | -1127 | -1472 | -748 | -515 | 1585 | -1536 | -1163 | 120 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 115(M) | 1831 | 2019 | -2596 | -2038 | -605 | -1979 | -1126 | 244 | -1727 | -359 | 2501 | -1655 | -2145 | -1435 | -1683 | -1106 | -557 | 1087 | -1153 | -804 | 121 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 116(Q) | -987 | -2211 | -43 | -62 | -2833 | 2229 | -691 | -2616 | -407 | -2604 | -1797 | 1197 | -1917 | 2260 | -858 | -880 | -1045 | -2139 | -2772 | -2099 | 122 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 117(G) | 2313 | -1042 | -2391 | -2526 | -3250 | 2601 | -2372 | -2972 | -2637 | -3257 | -2407 | -1721 | -2032 | -2310 | -2646 | -662 | -859 | -2003 | -3434 | -3247 | 123 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 118(Q) | -914 | -2350 | -48 | 1661 | -2621 | -1571 | 2504 | -2400 | 68 | -2331 | -1486 | -201 | -1796 | 2646 | -351 | -754 | -865 | -1984 | -2463 | -1787 | 124 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 119(W) | -517 | -1294 | -733 | -183 | -1062 | -1605 | -234 | -1037 | 19 | -1207 | -456 | 1435 | -1690 | 33 | 756 | 411 | -454 | -819 | 3340 | 1286 | 125 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 120(M) | 410 | -469 | -2417 | -1828 | -341 | -2041 | -897 | 195 | -1513 | -156 | 3130 | -1534 | -2102 | -1230 | -1484 | -1117 | -507 | 954 | -894 | 2253 | 126 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 121(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 127 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 122(G) | 2142 | -930 | -2334 | -2298 | -3100 | 2237 | -2139 | -2842 | -2302 | -3074 | -2187 | -1557 | -1909 | -2010 | -2397 | 1136 | -701 | -1871 | -3308 | -3053 | 128 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 123(V) | -1514 | -1144 | -3950 | -3459 | 1821 | -3487 | -2577 | 2274 | -3208 | -209 | -87 | -3112 | -3362 | -2864 | -3118 | -2680 | -1476 | 2426 | -2194 | -1786 | 129 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 124(V) | -1743 | -1294 | -4292 | -3873 | -1511 | -3988 | -3433 | 2287 | -3712 | 598 | -319 | -3626 | -3774 | -3456 | -3716 | -3260 | -1717 | 2790 | -2931 | -2577 | 130 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 125(A) | 2911 | -954 | -2808 | -2665 | -2115 | -1577 | -2196 | -575 | -2445 | -1646 | -1202 | -1906 | -2208 | -2218 | -2451 | -901 | -876 | -1294 | -2727 | -2394 | 131 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 126(I) | -1764 | -1323 | -4298 | -3936 | -1668 | -3994 | -3655 | 3337 | -3783 | -508 | -462 | -3689 | -3838 | -3608 | -3835 | -3311 | -1759 | 1847 | -3164 | -2747 | 132 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 127(G) | -1157 | -1705 | -2169 | -2375 | -3654 | 3021 | -2534 | -3611 | -2730 | -3741 | -2984 | -2024 | 2418 | -2475 | -2826 | -1361 | -1555 | -2705 | -3513 | -3509 | 133 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 128(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 134 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 129(C) | -2476 | 5738 | -4102 | -4358 | -3712 | -2763 | -3545 | -3518 | -4167 | -3859 | -3569 | -3631 | -3363 | -4030 | -3832 | -2793 | -2860 | -3158 | -3464 | -3718 | 135 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 130(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 136 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 131(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 137 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 132(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 138 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 133(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 139 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 134(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 140 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 135(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 141 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 136(A) | 2180 | -935 | -2286 | -2196 | -3057 | 1098 | -2058 | -2796 | -2174 | -3021 | -2134 | -1516 | -1898 | -1906 | -2302 | 2146 | -689 | -1849 | 3256 | -2983 | 142 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 137(M) | -1799 | -1433 | -4142 | -3579 | -669 | -3668 | -2608 | 1558 | -3293 | 1235 | 3799 | -3296 | -3401 | -2717 | -3088 | -2843 | -1726 | 1156 | -2002 | -1868 | 143 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 138(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 144 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 139(A) | 3103 | -1036 | -2445 | -2572 | -3222 | 1051 | -2380 | -2930 | -2650 | -3226 | -2381 | -1739 | -2034 | -2327 | -2648 | -664 | -857 | -1981 | -3412 | -3228 | 145 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 140(M) | -2325 | -1891 | -4598 | -4012 | -498 | -4222 | -3013 | 1242 | -3722 | 1864 | 3929 | -3855 | -3711 | -2910 | -3414 | -3439 | -2215 | -299 | -2076 | -2098 | 146 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 141(A) | 3103 | -1036 | -2445 | -2572 | -3222 | 1051 | -2380 | -2930 | -2650 | -3226 | -2381 | -1739 | -2034 | -2327 | -2648 | -664 | -857 | -1981 | -3412 | -3228 | 147 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 142(R) | -1588 | -2442 | -1399 | -953 | -3069 | -2171 | -708 | -2795 | 373 | -2625 | -1916 | 1858 | -2357 | -324 | 3294 | -1520 | -1505 | -2453 | -2523 | -2186 | 148 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 143(M) | -1448 | -1256 | -3396 | -2819 | -474 | -3024 | -1923 | 175 | -2473 | 2225 | 2756 | -2574 | -2922 | -2063 | -2375 | -2153 | 952 | -151 | -1599 | -1410 | 149 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 144(N) | -1662 | -3306 | 2055 | 78 | -3621 | -1643 | -1040 | -3622 | -1272 | -3531 | -2870 | 3477 | -2182 | -724 | -2071 | -1371 | -1757 | -3092 | -3633 | -2700 | 150 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 145(I) | -1066 | -921 | -2828 | -2239 | -1041 | -2675 | -1601 | 2235 | -1668 | -455 | -92 | -2067 | -2692 | -1688 | 1701 | -1795 | -1024 | 1960 | -1771 | -1396 | 151 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 146(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 152 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 147(S) | 1568 | -940 | -2267 | -2192 | -3082 | 1101 | -2068 | -2826 | -2185 | -3049 | -2159 | -1515 | -1901 | -1915 | -2313 | 2603 | -694 | -1866 | -3279 | -3006 | 153 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 148(I) | -1880 | -1492 | -4195 | -3728 | -963 | -3841 | -2991 | 3272 | -3425 | 246 | 2277 | -3490 | -3613 | -3014 | -3317 | -3092 | -1841 | 628 | -2385 | -2163 | 154 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 149(F) | -2204 | -1797 | -3724 | -3473 | 3206 | -3383 | -628 | -1077 | -3092 | -746 | 3167 | -2502 | -3309 | -2372 | -2792 | -2535 | -2120 | -1245 | 28 | 2460 | 155 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 150(V) | 1265 | -1028 | -3200 | -2994 | -1833 | -2150 | -2480 | 417 | -2771 | -1122 | -818 | -2349 | -2640 | -2559 | -2766 | -1464 | -1118 | 3028 | -2700 | -2325 | 156 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | | |
|---|---|---|---|---|---|---|---|---|---|---|---|---|---|---|---|---|---|---|---|---|---|
| 151(Y) | -3482 | -2868 | -3701 | -3919 | 238 | -3552 | -1112 | -3000 | -3638 | -2516 | -2526 | -3027 | -3772 | -3101 | -3341 | -3418 | -3527 | -3071 | -441 | 4711 | 157 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 152(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 158 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 153(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 159 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 154(T) | -359 | -976 | -2225 | -2229 | -2900 | -1242 | -2074 | -2560 | -2170 | -2875 | -2064 | -1561 | -1958 | -1969 | -2247 | 1110 | 3375 | -1760 | -3152 | -2850 | 160 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 155(I) | -2091 | -1746 | -3971 | -3840 | -1676 | -3532 | -3289 | 3684 | -3581 | -659 | -693 | -3562 | 3674 | 3445 | -3521 | -3194 | -2146 | 449 | -2877 | -2493 | 161 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 156(H) | 861 | -1924 | -384 | 1010 | -2260 | -1477 | 1787 | -1974 | 1769 | -1918 | -1022 | -120 | -1566 | 362 | 697 | -417 | -459 | -1557 | -2073 | -1446 | 162 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 157(P) | -655 | -1502 | -711 | -557 | -2204 | -1463 | 2143 | -2122 | -586 | -2233 | -1445 | -688 | 2941 | -560 | -941 | 855 | -805 | -1657 | -2369 | -1763 | 163 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 158(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 164 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 159(H) | -744 | -2193 | -114 | 1118 | -2513 | -1512 | 2486 | -2522 | 1178 | -2183 | -1308 | 2230 | -1689 | 180 | -233 | -598 | -687 | -1823 | -2335 | -1670 | 165 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 160(W) | -2672 | -2139 | -3850 | -3748 | 941 | -3611 | -469 | -1691 | -3306 | 1047 | -1217 | -2551 | -3534 | -2514 | -2960 | -2788 | -2577 | -1799 | 4205 | -3466 | 166 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 161(K) | 386 | -1981 | 779 | 279 | -2295 | -1403 | -114 | -2043 | 2059 | -1991 | -1082 | 941 | -1536 | 1263 | -211 | -384 | -457 | -1602 | -2161 | -1476 | 167 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 162(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 168 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 163(K) | -1144 | -2365 | -912 | 2048 | -2856 | -1912 | -326 | -2459 | 2267 | -2295 | -1482 | -556 | -1989 | 108 | 1334 | -1013 | -1014 | -2093 | -2324 | -1881 | 169 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 164(D) | -1091 | -2610 | 2941 | 174 | -2957 | -1527 | -595 | -2750 | 1084 | -2696 | -1877 | -176 | -1885 | -206 | -1006 | 740 | -1098 | -2288 | -2880 | -2105 | 170 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 165(L) | -2387 | -1922 | -4674 | -4155 | -617 | -4366 | -3250 | 1889 | -3865 | 2650 | 558 | -4023 | -3847 | -3098 | -3586 | -3647 | -2296 | -38 | -2247 | -2224 | 171 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 166(N) | -1021 | -2427 | -1806 | 133 | -2870 | -1499 | -635 | -2647 | -521 | -2640 | -1825 | 2171 | -1874 | -255 | -1124 | -860 | 2122 | -2184 | -2853 | -2090 | 172 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 167(I) | -1830 | -1390 | -4327 | -3873 | -1210 | -3994 | -3274 | 2967 | -3678 | 1259 | -30 | -3633 | -3730 | -3283 | -3604 | -3249 | -1791 | 1570 | -2661 | -2417 | 173 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 168(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 174 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 169(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 175 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 170(A) | 2440 | -824 | -2371 | -2082 | -1993 | -1344 | -1704 | -1264 | -1899 | -1832 | -1137 | -1517 | -1946 | -1674 | -2005 | 1075 | -641 | 1474 | -2390 | -2055 | 176 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 171(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 177 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 172(E) | -2641 | -3308 | -896 | 3732 | -3966 | -3458 | -2043 | -4105 | -2128 | -4016 | -3555 | -1531 | -2959 | -1842 | -2560 | -2479 | -2750 | -3722 | -3563 | -3385 | 178 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 173(A) | 2966 | -1031 | -2429 | -2551 | -3222 | 1544 | -2368 | -2934 | -2633 | -3225 | -2377 | -1727 | -2028 | -2309 | -2637 | -656 | -850 | -1980 | -3412 | -3224 | 179 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 174(V) | -1769 | -1342 | -4255 | -3793 | -1216 | -3901 | -3162 | 1633 | -3589 | 1486 | -51 | -3537 | -3667 | -3214 | -3518 | -3143 | -1731 | 2692 | -2609 | -2345 | 180 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 175(G) | -2594 | -2690 | -3304 | -3623 | -4328 | 3747 | -3462 | -4761 | -3953 | -4671 | -4212 | -3320 | -3352 | -3748 | 3779 | -2839 | -2981 | -4004 | -3668 | -4221 | 181 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 176(Q) | -729 | -2116 | -413 | 1096 | -2484 | -1587 | 1599 | -2186 | 1695 | -2094 | -1219 | -223 | -1698 | 2418 | 90 | -599 | -649 | -1770 | -2213 | -1615 | 182 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 177(W) | -1652 | -1707 | -2340 | -1879 | 1996 | -2733 | -2013 | -1398 | -1758 | -1386 | -938 | -1641 | -2751 | -1364 | -1762 | -1780 | -1577 | -1325 | 3577 | 2136 | 183 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 178(T) | -421 | -753 | -1251 | -704 | -846 | -1670 | -535 | 894 | -548 | -690 | -1 | 1376 | -1791 | -421 | -846 | 373 | 1461 | 858 | -1236 | -812 | 184 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 179(H) | 1498 | -1593 | -504 | 15 | -1895 | -1484 | 2279 | -1559 | 1119 | -1640 | -810 | -242 | -1611 | 194 | -171 | -462 | 815 | -1231 | -1914 | -1340 | 185 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 180(G) | -1515 | -2130 | -1298 | -1450 | -2658 | 3285 | 2212 | -3276 | -1691 | -3291 | -2638 | -1524 | -2562 | -1662 | -1925 | -1600 | -1764 | -2713 | -2804 | -2234 | 186 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 181(K) | -528 | -2010 | 1346 | 1082 | -2329 | -1408 | -118 | -2080 | 1475 | -2018 | -1108 | 1161 | -1543 | 331 | 1052 | -394 | -471 | -1632 | -2181 | -1494 | 187 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 182(M) | -1894 | -1521 | -4170 | -3679 | -840 | -3793 | -2866 | 2827 | -3360 | 375 | 3445 | -3437 | -3555 | -2902 | -3223 | -3028 | -1846 | 470 | -2249 | -2059 | 188 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 183(T) | -670 | -1758 | 1731 | -141 | -2591 | -1399 | -691 | -2319 | -499 | -2384 | -1543 | -387 | -1786 | -316 | -1016 | 1576 | 2044 | -1811 | -2624 | -1981 | 189 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 184(E) | 345 | -2074 | 925 | 1994 | -2378 | -1408 | -177 | -2135 | -922 | -2084 | -1183 | -38 | 641 | 264 | -356 | -444 | -536 | -1690 | -2261 | -1556 | 190 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 185(E) | -1493 | -2900 | 93 | 3174 | -2903 | -1743 | 1987 | -3042 | -646 | -2957 | -2238 | -411 | -2146 | -506 | -1121 | -1272 | -1503 | -2629 | -2905 | -2134 | 191 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 186(D) | -1293 | -2959 | 2673 | 2121 | -3219 | -1546 | -713 | -3043 | -707 | -2974 | -2191 | -158 | -1967 | -342 | -1394 | -1043 | 701 | -2567 | -3172 | -2311 | 192 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 187(F) | -1137 | -905 | -3250 | -2707 | 2365 | -2647 | -1016 | -34 | -2336 | 1239 | 267 | -2150 | -2626 | -1861 | -2133 | -1752 | -1069 | 1461 | -599 | 1844 | 193 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 188(K) | -479 | -1713 | -409 | 1031 | -1925 | -1467 | 1755 | -1650 | 1844 | -349 | -827 | -140 | -1556 | 319 | -75 | -403 | -411 | -1301 | -1900 | 843 | 194 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 189(G) | 433 | -2144 | 52 | 1047 | -2717 | 2303 | -615 | -2467 | -442 | -2482 | -1655 | 1123 | -1828 | -233 | -995 | -763 | -923 | -2000 | -2710 | -2005 | 195 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 190(V) | -1752 | -1320 | -4254 | -3806 | -1311 | -3916 | -3232 | 1701 | -3614 | 1188 | -140 | -3551 | -3693 | -3280 | -3568 | -3166 | -1718 | 2833 | -2703 | -2409 | 196 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 191(E) | -1199 | -1750 | -734 | 2668 | -1820 | -2038 | -1068 | 1892 | -867 | -1273 | -897 | -922 | -2295 | -797 | -1238 | -1340 | -1197 | -426 | -2325 | -1789 | 197 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 192(C) | -1182 | 3528 | -1398 | -620 | -2541 | -2038 | -358 | -2093 | 1181 | -2037 | -1272 | -747 | -2070 | 1553 | 2213 | -1123 | -1038 | -1817 | -2142 | -1774 | 198 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 193(N) | -1478 | -2527 | -261 | -403 | -2011 | -1837 | 2032 | -2925 | -735 | -2845 | -2195 | 3635 | -2259 | -721 | -1085 | -1352 | -1546 | -2522 | -2307 | -1431 | 199 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 194(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 200 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 195(C) | -1220 | 4911 | -3609 | -3314 | -1440 | -2525 | -2482 | 1565 | -2922 | -706 | -544 | -2678 | -2896 | -2710 | -2836 | -1869 | -1375 | 379 | -2371 | -1957 | 201 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 196(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 202 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 197(G) | -477 | -1115 | -1983 | -2189 | -3315 | 3154 | -2272 | -3172 | -2506 | -3387 | -2522 | -1599 | -2042 | -2177 | -2583 | 1217 | -905 | -2130 | -3477 | -3225 | 203 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 198(A) | 1653 | -1347 | -705 | -249 | -1969 | -1385 | -477 | -1629 | -159 | -1759 | -935 | -434 | 1285 | 1404 | -586 | -450 | 1019 | -1243 | -2070 | -1522 | 204 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| 199(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 205 |
|---|---|---|---|---|---|---|---|---|---|---|---|---|---|---|---|---|---|---|---|---|---|
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 200(S) | 1870 | -938 | -2270 | -2183 | -3068 | 1488 | -2056 | -2810 | -2168 | -3032 | -2144 | -1511 | -1898 | -1901 | -2300 | 2236 | -690 | -1857 | -3265 | -2990 | 206 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 201(C) | -2476 | 5733 | -4102 | -4358 | -3712 | -2763 | -3545 | -3518 | -4167 | -3859 | -3569 | -3631 | -3363 | -4030 | -3832 | -2793 | -2860 | -3158 | -3464 | -3718 | 207 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 202(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 208 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 203(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 209 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 204(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 210 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 205(Y) | -3590 | -2700 | -4146 | -4379 | 2092 | -4028 | -404 | -2517 | -3963 | -1928 | -1973 | -2744 | -3921 | -2845 | -3431 | -3284 | -3474 | -2669 | 336 | 4423 | 211 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 206(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 212 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| 207(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 213 |
|---|---|---|---|---|---|---|---|---|---|---|---|---|---|---|---|---|---|---|---|---|---|
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 208(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 214 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 209(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 215 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 210(M) | -2355 | -1988 | -4343 | -3834 | -504 | -4051 | -2868 | -105 | -3385 | 1451 | 4460 | -3680 | -3671 | -2806 | -3171 | -3327 | -2274 | -474 | -2039 | -1925 | 216 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 211(S) | 2150 | -939 | -2407 | -2415 | -3075 | -1197 | -2205 | -2781 | -2384 | -3065 | -2205 | -1613 | -1936 | -2105 | -2436 | 2652 | -729 | -1850 | -3306 | -3049 | 217 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 212(S) | -344 | -979 | -2190 | -2162 | -2959 | -1227 | -2042 | -2651 | -2116 | -2934 | -2100 | -1526 | -1941 | -1909 | -2222 | 2940 | 1775 | -1804 | -3187 | -2882 | 218 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 213(A) | 3048 | -932 | -2480 | -2533 | -3075 | -1200 | -2274 | -2765 | -2501 | -3071 | -2221 | -1658 | -1948 | -2205 | -2512 | 1225 | -739 | -1842 | -3322 | -3078 | 219 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 214(I) | -1924 | -1546 | -4067 | -3658 | 2312 | -3663 | -2081 | 3030 | -3367 | 150 | 99 | -3197 | -3492 | -2821 | -3179 | -2894 | -1877 | 293 | -1445 | -692 | 220 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 215(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 221 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 216(A) | 2389 | -814 | -2506 | -2162 | -1696 | -1545 | -1698 | -499 | -1942 | -1398 | -813 | -1640 | -2076 | -1723 | -2027 | -806 | 1148 | 1559 | -2200 | -1856 | 222 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 217(M) | -2576 | -2118 | -4725 | -4165 | -461 | -4430 | -3165 | 99 | -3811 | 2513 | 3454 | -4075 | -3839 | -2978 | -3488 | -3704 | -3457 | -591 | -2111 | -2145 | 223 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 218(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 224 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 219(M) | -2313 | -1968 | -4258 | -3765 | -518 | -3966 | -2806 | 98 | -3289 | 1292 | 4523 | -3599 | -3636 | -2769 | -3097 | -3249 | -2243 | -457 | -2026 | -1874 | 225 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 220(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 226 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 221(L) | -2631 | -2159 | -4786 | -4228 | -462 | -4506 | -3231 | 96 | -3878 | 2828 | 2482 | -4157 | -3880 | -3016 | -3541 | -3793 | -2509 | -608 | -2134 | -2182 | 227 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 222(P) | -1501 | -1778 | -2473 | -2371 | -1710 | -2311 | -2045 | -1321 | -2060 | 827 | -1068 | -2173 | 3594 | -2082 | -2130 | -1799 | -1699 | -1373 | -2373 | 1942 | 228 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 223(Y) | -1068 | -1670 | -865 | -836 | -631 | 1198 | -767 | -1828 | -1059 | -1914 | -1304 | 692 | -2203 | -906 | -1387 | -1136 | -1163 | -1566 | -1185 | 3670 | 229 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 224(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 230 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 225(S) | 1172 | -954 | -2367 | -2422 | -3120 | -1204 | -2237 | -2835 | -2426 | -3122 | -2265 | -1621 | -1948 | -1245 | -2467 | 3107 | -749 | -1884 | -3349 | -3092 | 231 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 226(S) | -342 | -975 | -2176 | -2124 | -2912 | -1229 | -2003 | -2594 | -2067 | -2878 | -2048 | -1510 | -1936 | -1866 | -2184 | 2553 | 2492 | -1773 | -3143 | -2833 | 232 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 227(M) | -720 | -1440 | -710 | -343 | -1228 | -1693 | 2436 | -1209 | -132 | -1364 | 3099 | 1904 | -1852 | -183 | -458 | -776 | -680 | -1004 | -1540 | -890 | 233 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 228(P) | 2240 | -1100 | -2241 | -2293 | -3037 | -1346 | -2188 | -2683 | -2317 | -2986 | -2210 | -1663 | 3041 | -2093 | -2391 | -722 | -895 | -1893 | -3243 | -2988 | 234 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 229(A) | 2958 | -1235 | -1299 | -1377 | -2868 | -1345 | -1673 | -2580 | -1661 | -2843 | -2054 | 1555 | -1995 | -1468 | -1921 | -715 | -888 | -1871 | -3064 | -2630 | 235 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 230(E) | -509 | -1046 | -884 | 1564 | -1116 | -1669 | -441 | -485 | -283 | 250 | -206 | -577 | 689 | -200 | -656 | -670 | -459 | 1290 | -1467 | -995 | 236 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 231(D) | -1203 | -2412 | 2595 | -117 | -3286 | -1536 | -1087 | -3176 | -1165 | -3186 | -2436 | -428 | -2068 | -736 | -1824 | 2377 | -1366 | -2578 | -3334 | -2552 | 237 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 232(Q) | 954 | -1983 | -100 | -971 | -2337 | 177 | -267 | -2067 | 81 | -2060 | -1189 | -125 | -1637 | 2600 | -418 | -514 | -597 | -1649 | -2268 | -1597 | 238 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 233(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 239 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 234(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 240 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 235(R) | 377 | -1802 | -415 | 988 | -2095 | -1474 | -95 | -1786 | 1452 | -1785 | -911 | -135 | -1560 | 343 | 1555 | -409 | -431 | 376 | -1986 | -1375 | 241 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 236(D) | -1083 | -1565 | 2662 | -244 | -1941 | -1573 | -679 | 612 | -527 | -1651 | -980 | -490 | -1869 | -358 | -1003 | -771 | -766 | -903 | -2208 | -1633 | 242 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 237(E) | -1225 | -2868 | 1894 | 1948 | -3149 | -1532 | -671 | -2975 | -630 | -2902 | -2101 | -150 | -1935 | -293 | -1299 | 1884 | -1241 | -2496 | -3093 | -2248 | 243 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 238(C) | 1375 | 3262 | -2620 | -2108 | -827 | -1866 | -1276 | 1631 | -1811 | -599 | -10 | -1674 | -2137 | -1531 | -1786 | -1034 | 790 | 249 | -1361 | -1010 | 244 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 239(E) | 635 | -1796 | -1055 | 1761 | -2018 | -1464 | -263 | 1191 | 28 | -1767 | -946 | -148 | -2068 | -736 | -1824 | 2377 | -1366 | -2578 | -3334 | -2552 | 245 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 240(E) | 593 | -2044 | -252 | 2548 | -2437 | -1542 | -329 | -2133 | 151 | -2120 | -1274 | -244 | -1738 | 89 | -946 | -646 | -717 | -1734 | -2305 | -1686 | 246 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 241(S) | 1884 | -835 | -1962 | -1576 | -1634 | -1436 | -1320 | 1040 | -1409 | -1453 | -781 | -1293 | -1922 | -1241 | -1606 | 1973 | -597 | -669 | -2036 | -1656 | 247 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 242(G) | 2267 | -1043 | -2388 | -2526 | -3253 | 2642 | -2373 | -2975 | -2639 | -3260 | -2410 | -1722 | -2033 | 2311 | -2648 | -663 | -860 | -2005 | -3436 | -3250 | 248 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 243(R) | -876 | -2087 | -829 | 1490 | -2474 | -1766 | -229 | -2106 | 1269 | -44 | -1198 | -424 | -1829 | 205 | 2225 | -775 | -768 | -1753 | -2143 | -1647 | 249 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 244(V) | 2339 | -967 | -2970 | -2766 | -1878 | -1847 | -2252 | 32 | -2541 | -1299 | -918 | -2087 | -2399 | -2316 | -2545 | -1157 | -971 | 2345 | -2605 | -2251 | 250 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 245(I) | -1827 | -1398 | -4307 | -3831 | -1099 | -3939 | -3142 | 2286 | -3619 | 1835 | 69 | -3579 | -3671 | -3177 | -3511 | -3178 | -1781 | 1918 | -2524 | -2310 | 251 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 246(V) | -1178 | -1448 | -1943 | -1452 | -1776 | -2261 | -1140 | -227 | 1866 | -1260 | -816 | -1444 | -2448 | -902 | -540 | -1496 | -1176 | 2697 | -2161 | -1764 | 252 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 247(E) | -508 | -1976 | 840 | 1547 | -2280 | -1393 | -117 | -2029 | 1400 | -1984 | -1077 | 1158 | -1531 | 330 | -253 | -378 | -454 | -262 | -2163 | -1471 | 253 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 248(M) | 1703 | -991 | -2901 | -2342 | -528 | -2567 | -1550 | 166 | -2031 | 1544 | 2668 | -2104 | -2591 | -1715 | -2010 | -1685 | -1052 | -12 | -1442 | -1177 | 254 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 249(I) | -1947 | -1516 | -4385 | -3885 | -916 | -4013 | -3118 | 2193 | -3656 | 2186 | 257 | -3656 | -3687 | -3109 | -3494 | -3250 | -1889 | 1383 | -2397 | -2258 | 255 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 250(E) | -1322 | -2647 | -272 | 2491 | -3071 | -1811 | -576 | -2759 | 2306 | -2633 | -1854 | -464 | -2066 | -175 | -177 | -1144 | -1256 | -2368 | -2692 | -2140 | 256 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 251(K) | -1395 | -2059 | -1711 | -1014 | -2215 | -2218 | -641 | -1709 | 3021 | -1652 | 2578 | -1075 | 2303 | -282 | 287 | -1423 | -1283 | -1603 | -2159 | -1803 | 257 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 252(D) | -1285 | -2888 | 2677 | 176 | -3210 | 1189 | -737 | -3047 | -715 | -2977 | -2195 | -190 | -1979 | 2106 | -1379 | -1050 | -1315 | -2564 | -3161 | -2320 | 258 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 253(I) | -2073 | -1632 | -4434 | -3975 | -911 | -4130 | -3238 | 3164 | -3706 | 1451 | 244 | -3779 | -3785 | -3187 | -3557 | -3413 | -2021 | -546 | -2449 | -2273 | 259 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 254(K) | -1570 | -2144 | -1887 | -1191 | -2098 | -2363 | -750 | -1603 | 3034 | 938 | -1112 | -1231 | -2436 | -408 | 215 | -1616 | -1443 | -1580 | -2166 | -1804 | 260 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 255(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | 3594 | -4064 | 261 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 256(R) | -928 | -1705 | -1507 | -1055 | -2761 | -1730 | -896 | -2490 | -44 | -2489 | -1723 | -1042 | -2102 | -543 | 2614 | 2258 | -1053 | -1998 | -2546 | -2158 | 262 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 257(D) | -1280 | -2865 | 3154 | 175 | -3194 | -1547 | -743 | -3034 | -728 | -2971 | -2194 | -190 | -1979 | 1342 | -1391 | 553 | -1316 | -2552 | -3161 | -2317 | 263 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 258(I) | -1997 | -1562 | -4355 | -3927 | -1042 | -4066 | -3261 | 3343 | -3654 | 937 | 97 | -3718 | -3783 | -3239 | -3555 | -3364 | -1959 | 702 | -2549 | -2295 | 264 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 259(M) | -2252 | -1821 | -4572 | -3991 | -530 | -4164 | -2990 | -2068 | -3709 | 1993 | 3197 | -3808 | -3685 | 2916 | -3406 | -3378 | -2149 | -172 | -2084 | -2091 | 265 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 260(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 266 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 261(R) | -2131 | -2786 | -2704 | -1460 | -3618 | -2638 | -587 | -2976 | 1735 | -2645 | -1985 | -1353 | -2603 | -173 | 3492 | -2020 | -1828 | -2748 | -2484 | -2384 | 267 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 262(K) | -1349 | -2635 | -381 | 2083 | -3083 | -1857 | -565 | -2750 | 2690 | -2612 | -1837 | -514 | -2090 | -161 | -61 | -1178 | -1271 | -2369 | -2655 | -2138 | 268 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| 263(A) | 2821 | -932 | -2451 | -2472 | -3065 | -1198 | -2233 | -2763 | -2434 | -3056 | -2201 | -1633 | -1940 | -2147 | -2468 | 1831 | -730 | -1840 | -3305 | -3055 | 269 |
|---|---|---|---|---|---|---|---|---|---|---|---|---|---|---|---|---|---|---|---|---|---|
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 264(F) | -2063 | -1686 | -4037 | -3677 | 3437 | -3644 | -1706 | 2063 | -3359 | 135 | 67 | -3095 | -3486 | -2739 | -3127 | -2876 | -2012 | -83 | -1038 | -158 | 270 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 265(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 271 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 266(N) | -1662 | -3306 | 2055 | 78 | -3621 | -1643 | -1040 | -3622 | -1272 | -3531 | -2870 | 3477 | -2182 | -724 | -2071 | -1371 | -1757 | -3092 | -3633 | -2700 | 272 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 267(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 273 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 268(I) | -1760 | -1307 | -4325 | -3962 | -1735 | -4042 | -3726 | 3135 | -3828 | -579 | -515 | -3722 | -3869 | -3673 | -3896 | -3359 | -1752 | 2276 | -3240 | -2806 | 274 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 269(T) | 1428 | -904 | -2334 | -2158 | -2747 | -1206 | -1940 | -2392 | -2037 | -2678 | -1846 | -1504 | -1896 | -1809 | -2163 | 902 | 3001 | -1635 | -2999 | -2705 | 275 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 270(V) | -1745 | -1300 | -4286 | -3858 | -1446 | -3967 | -3370 | 2358 | -3688 | 852 | -261 | -3606 | -3749 | -3403 | -3673 | -3232 | -1717 | 2643 | -2856 | -2524 | 276 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 271(V) | -1404 | -1072 | -3766 | -3305 | -1464 | -3356 | -2696 | 2276 | -3080 | -616 | -379 | -3001 | -3325 | -2870 | -3091 | -2563 | 1344 | 2521 | -2516 | -2113 | 277 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 272(M) | 866 | -1113 | -2656 | -2412 | -1322 | -1920 | -1883 | -487 | -2061 | -587 | 4451 | -1950 | -2387 | -1928 | -2078 | -1220 | -1053 | -498 | -2134 | -1803 | 278 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 273(A) | 2601 | -957 | -2898 | -2711 | -1943 | -1740 | -2211 | -165 | -2487 | -1406 | -1001 | -2008 | -2320 | -2260 | -2494 | -1053 | -929 | -1990 | -2626 | -2279 | 279 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 274(L) | -1171 | -983 | -3266 | -2733 | -796 | -2795 | -1888 | 590 | -2418 | 2001 | 198 | -2418 | -2816 | -2106 | -2362 | -1944 | 965 | 1777 | -1724 | -1426 | 280 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 275(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 281 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 276(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 282 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 277(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 283 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 278(T) | -1213 | -1674 | -2755 | -2906 | -3163 | -1922 | -2659 | -2698 | -2788 | -3105 | -2612 | -2311 | 2600 | -2708 | -2753 | -1463 | 3819 | -2197 | 3286 | 3156 | 284 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | | |
|---|---|---|---|---|---|---|---|---|---|---|---|---|---|---|---|---|---|---|---|---|---|
| 279(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 285 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 280(A) | 3134 | -934 | -2491 | -2567 | -3083 | -1203 | -2300 | -2766 | -2540 | -3082 | -2237 | -1672 | -1954 | -2240 | -2537 | 874 | -747 | -1844 | -3333 | -3093 | 286 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 281(V) | -984 | -1045 | -3169 | -2909 | -1709 | -2304 | -2404 | 531 | -2643 | -988 | -697 | -2378 | -2722 | -2480 | -2661 | -1601 | 1504 | 3014 | -2588 | -2201 | 287 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 282(L) | -2631 | -2159 | -4786 | -4228 | -462 | -4506 | -3261 | 96 | -3878 | 2828 | -2482 | -4157 | -3880 | -3016 | -3541 | -3793 | -2509 | -608 | -2134 | -2182 | 288 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 283(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 289 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 284(L) | -1623 | -1338 | -3726 | -3164 | -251 | -3255 | -1820 | 1373 | -2808 | 2371 | 514 | -2785 | -3086 | -2281 | -2613 | -2389 | -1543 | -161 | -1311 | 1782 | 290 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 285(L) | -2333 | -1873 | -4640 | -4127 | -650 | -4326 | -3241 | 2176 | -3843 | 2519 | 526 | -3982 | -3833 | -3105 | -3579 | -3604 | -2247 | 56 | -2268 | -2230 | 291 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 286(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 292 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 287(M) | -1886 | -1507 | -4178 | -3693 | -877 | -3806 | -2901 | -3008 | -3380 | 335 | 3109 | -3451 | -3570 | -2934 | -3251 | -3044 | -1840 | 524 | -2288 | -2089 | 293 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 288(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 294 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 289(H) | -1490 | -2484 | -362 | -476 | -1816 | -1880 | 4320 | -2854 | -684 | -2770 | -2133 | 2185 | 2285 | -728 | -1000 | -1377 | -1550 | -2475 | -2146 | -1255 | 295 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 290(A) | 2439 | -911 | -2326 | -2131 | -2811 | -1197 | -1934 | -2480 | -2011 | -2745 | -1898 | -1490 | -1888 | -1785 | -2153 | -1898 | 1073 | -1682 | -3044 | -2749 | 296 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 291(I) | 2038 | -985 | -3388 | -2919 | -1320 | -2893 | -2277 | 2155 | -2677 | -587 | -297 | -2593 | -2992 | -2450 | -2697 | -2087 | -1208 | 1681 | -2229 | -1846 | 297 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 292(H) | -1243 | -2769 | 311 | 1902 | -3172 | 1980 | -744 | -2992 | -697 | -2936 | -2152 | 1923 | -1974 | -377 | -1331 | -1030 | -1284 | -2506 | -3125 | -2308 | 298 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 293(V) | -1738 | -1298 | -4281 | -3921 | -1737 | -3979 | -3665 | 1917 | -3774 | -601 | -528 | -3671 | -3834 | -3628 | -3843 | -3293 | -1735 | 3205 | -3215 | -2770 | 299 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 294(E) | -833 | -2344 | 1092 | 2412 | -2643 | -1464 | -386 | -2413 | -146 | -2369 | -1505 | -96 | 562 | 29 | -717 | -666 | -862 | -1966 | -2562 | -1818 | 300 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 295(W) | -1380 | -1116 | -3614 | -3026 | 1322 | -2981 | -1582 | 1966 | -2661 | 1775 | 556 | -2562 | -2865 | -2117 | -2424 | 2098 | -1302 | -187 | 2908 | -629 | 301 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 296(T) | -350 | -973 | -2204 | -2178 | -2893 | -1236 | -2035 | -2561 | -2117 | -2862 | -2043 | -1536 | -1946 | -1916 | -2214 | -1618 | 3198 | -1758 | -3137 | -2831 | 302 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 297(L) | -1443 | -1269 | -3144 | -3576 | -528 | -3014 | -1816 | 1945 | -2155 | 2102 | 508 | -2422 | -2899 | 1193 | -2133 | -2129 | -1369 | -50 | -1616 | -1384 | 303 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 298(D) | -1826 | -3682 | 3559 | 1199 | -3883 | -1662 | -1073 | -3846 | -1391 | -3720 | -3110 | -272 | -2222 | -760 | -2283 | -1471 | -1913 | -3321 | -3864 | -2864 | 304 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 299(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 305 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 300(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 306 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 301(Q) | -1048 | -2608 | 205 | 2170 | -2893 | -1535 | -505 | -2680 | -255 | -2604 | -1769 | 1814 | -1849 | 2272 | -789 | -848 | -1028 | -2228 | -2770 | -2013 | 307 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 302(R) | 1083 | -1687 | 691 | 135 | -2058 | -1406 | -178 | -1755 | 214 | -1793 | -924 | -145 | -1553 | 247 | 1670 | -383 | 1217 | -1367 | -2031 | -1404 | 308 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 303(I) | -1915 | -1536 | -4077 | -3667 | 2027 | -3678 | -2155 | 3137 | -3381 | 144 | 94 | -3225 | -3506 | -2848 | -3202 | -2914 | -1871 | 345 | -1522 | -791 | 309 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 304(R) | -689 | -2015 | -494 | 24 | -2395 | -1582 | -184 | -2087 | 444 | -2020 | -1151 | 1161 | -1687 | 1832 | 2131 | 626 | -614 | -1684 | -2156 | -1573 | 310 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 305(D) | 387 | -1967 | 1600 | 1359 | -2275 | -1391 | 1561 | -2025 | 282 | -1976 | -1067 | -25 | -1525 | 342 | 1024 | -369 | -443 | -1584 | -2152 | -1462 | 311 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 306(R) | -1460 | -2315 | -1793 | -887 | -2832 | -2237 | -431 | -2288 | 2193 | -2199 | -1473 | -946 | -2245 | -20 | 2706 | -1394 | -1275 | 591 | -2248 | -1961 | 312 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 307(V) | -941 | -1027 | -3099 | -2832 | -1692 | -2234 | -2324 | 470 | -2565 | -1003 | -695 | -2305 | -2663 | -2399 | -2587 | -1527 | 1858 | 2876 | -2536 | -2152 | 313 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 308(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 314 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 309(V) | -1090 | -1215 | -2097 | -1824 | -819 | -2221 | 2699 | -287 | -1392 | -1027 | -591 | -1674 | -2484 | -1446 | -1482 | -1482 | -1143 | 2879 | -1420 | -707 | 315 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 310(L) | -2439 | -1972 | -4702 | -4181 | -588 | -4401 | -3258 | 1582 | -3881 | 2757 | 587 | -4061 | -3862 | -3093 | -3590 | -3689 | -2344 | -130 | -2230 | -2217 | 316 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 311(C) | 2157 | 4166 | -3012 | -2973 | -2780 | 1022 | -2337 | -2398 | -2724 | -2744 | -1930 | -1786 | -1943 | -2372 | -2623 | -540 | -692 | -1624 | -3091 | -2881 | 317 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 312(D) | -1732 | -3453 | 3468 | 99 | -3733 | -1654 | -1066 | -3747 | -1356 | -3641 | -3008 | 1690 | -2201 | -755 | -2209 | -1416 | -1833 | -3208 | -3752 | -2776 | 318 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 313(L) | -2477 | -2023 | -4713 | -4122 | 1592 | -4329 | -2920 | 72 | -3835 | 2593 | 2472 | -3948 | -3754 | -2914 | -3466 | -3550 | -2350 | -634 | -1927 | -1830 | 319 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 314(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 320 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 315(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 321 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 316(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 322 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 317(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 323 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 318(K) | 2 | -2257 | -1073 | -374 | -2740 | -1908 | -278 | -2339 | 2328 | -2192 | -1373 | -562 | -1953 | 2273 | 1344 | -952 | -933 | -1980 | -2234 | -1799 | 324 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 319(Y) | -3482 | -2868 | -3701 | -3919 | 238 | -3552 | -1112 | -3000 | -3638 | -2516 | -2526 | -3027 | -3772 | -3101 | -3341 | -3418 | -3527 | -3071 | -441 | 4711 | 325 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 320(M) | -1559 | -1267 | -3829 | -3380 | -1103 | -3357 | -2655 | 805 | -3067 | -64 | 3046 | -3065 | -3326 | -2779 | -3011 | -2591 | -1556 | 2855 | -2313 | -1998 | 326 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 321(M) | 1225 | -469 | -2256 | -1679 | 1656 | -1926 | -870 | 90 | -1396 | -210 | 2763 | -1424 | -2028 | -1129 | -1411 | -1008 | 712 | 154 | -951 | -586 | 327 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 322(T) | -738 | -2094 | -84 | 1704 | -2416 | -1495 | -317 | -2135 | 61 | -2127 | -1275 | -163 | -1704 | 1857 | -405 | -613 | 1930 | -1734 | -2331 | -1668 | 328 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 323(D) | -1746 | -3458 | 3540 | 90 | -3744 | -1650 | -1081 | -3767 | -1381 | -3662 | -3036 | 1386 | -2211 | -772 | -2239 | -1429 | -1850 | -3226 | -3765 | -2789 | 329 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 324(L) | -2451 | -1983 | -4707 | -4186 | -582 | -4409 | -3259 | 1510 | -3884 | 2778 | 592 | -4069 | -3865 | -3091 | -3590 | -3698 | -2355 | -150 | -2226 | -2214 | 330 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 325(H) | -2923 | -2573 | -2959 | -2926 | 826 | -3449 | 4553 | -2508 | -2463 | -2054 | -1948 | -2279 | -3499 | -2191 | -2397 | -2761 | -2855 | -2540 | 123 | 2920 | 331 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 326(K) | 373 | -1957 | -342 | 1025 | -2297 | -1472 | -98 | -2018 | 2111 | -1954 | -1056 | 906 | -1570 | 352 | 685 | -424 | -473 | -1592 | -2105 | -1469 | 332 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 327(V) | 1739 | -1008 | -3509 | -3043 | -1376 | -3028 | -2406 | -1765 | -2807 | -615 | -334 | -2718 | -3093 | -2585 | -2823 | -2226 | -1263 | 2376 | -2322 | -1931 | 333 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 328(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 334 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 329(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 335 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 330(I) | -1758 | -1302 | -4331 | -3970 | -1756 | -4054 | -3748 | 2976 | -3840 | -603 | -533 | -3731 | -3877 | -3693 | -3914 | -3372 | -1750 | 2505 | -3265 | -2824 | 336 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 331(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 337 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 332(Q) | 1795 | -1440 | -730 | -492 | -2453 | 682 | -812 | -2151 | -508 | -2256 | -1426 | -624 | -1796 | 2666 | -901 | -590 | -689 | -1636 | -2510 | -1971 | 338 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 333(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 339 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 334(M) | -2355 | -1988 | -4343 | -3834 | -504 | -4051 | -2868 | 105 | -3385 | 1451 | 4460 | -3680 | -3671 | -2806 | -3171 | -3327 | -2274 | -474 | -2039 | -1925 | 340 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 335(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 341 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 336(Y) | -1187 | -974 | -3186 | -2638 | -117 | -2732 | -1255 | 1905 | -2270 | 73 | 1977 | -2217 | -2699 | -1882 | -2144 | -1841 | -1124 | 71 | -907 | 3254 | 342 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 337(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 343 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 338(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 344 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 339(K) | -864 | -1785 | -860 | -366 | -2128 | -1763 | -407 | -1612 | 2624 | -1800 | -1045 | 629 | -1900 | -28 | 62 | -851 | 805 | 1127 | -2064 | -1581 | 345 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 340(N) | 602 | -1686 | -275 | 1008 | -1926 | -1415 | -1528 | -1618 | 244 | -1673 | -815 | 1897 | -1530 | 299 | -244 | -371 | -391 | 322 | -1934 | -1306 | 346 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 341(G) | -1709 | -2639 | 1362 | -690 | -3785 | 3257 | -1671 | -3805 | -1946 | -3792 | -3137 | -980 | -2480 | -1424 | -2576 | -1630 | -1936 | -3150 | -3628 | -3155 | 347 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 342(F) | -942 | -799 | -2828 | -2226 | 1797 | -2476 | -1269 | 1109 | 581 | 1793 | 516 | -1952 | -2453 | -1557 | -1815 | -1558 | -875 | 52 | -1138 | -794 | 348 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 343(L) | -2451 | -1983 | -4707 | -4186 | -582 | -4409 | -3259 | 1510 | -3884 | 2778 | 592 | -4069 | -3865 | -3091 | -3590 | -3698 | -2355 | -150 | -2226 | -2214 | 349 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 344(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 350 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 345(G) | -2594 | -2690 | -3304 | -3623 | -4328 | 3747 | -3462 | -4761 | -3953 | -4671 | -4212 | -3320 | -3352 | -3748 | -3779 | 2839 | -2981 | -4004 | -3668 | -4222 | 351 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 346(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 352 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 347(C) | 774 | 4452 | -2162 | -1688 | -1962 | -1478 | -1302 | -1474 | -944 | -1796 | -1088 | -1351 | -1979 | -1147 | -1684 | -732 | -719 | -1116 | -2225 | -1881 | 353 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 348(L) | -2387 | -1922 | -4674 | -4155 | -617 | -4366 | -3250 | 1889 | -3865 | 2650 | 558 | -4023 | -3847 | -3098 | -3586 | -3647 | -2296 | -38 | -2247 | -2224 | 354 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 349(T) | -1213 | -1674 | -2755 | -2906 | -3163 | -1922 | -2659 | -2698 | 2788 | -3105 | -2612 | -2311 | -2600 | -2708 | -2753 | -1463 | 3819 | -2197 | -3286 | -3156 | 355 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 350(C) | -1489 | 2972 | -4007 | -3563 | -1524 | -3541 | -2939 | -2612 | -3350 | -617 | -413 | -3224 | -3470 | -3129 | -3335 | -2770 | -1475 | 2269 | -2657 | -2248 | 356 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 351(T) | -364 | -979 | -2232 | -2250 | -2904 | -1245 | -2090 | -2559 | -2191 | -2881 | -2075 | -1571 | -1964 | -1991 | -2260 | 905 | 3428 | -1762 | -3159 | -2858 | 357 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 352(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 358 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 353(K) | -1716 | -2632 | -2004 | -1008 | -3336 | -2379 | -444 | -2764 | 2775 | -2484 | -1756 | -1035 | -2357 | 2151 | 1811 | -1592 | -1477 | -2481 | -2391 | -2172 | 359 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 354(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 360 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 355(V) | -1771 | -1339 | -4275 | -3816 | -1235 | -3919 | -3194 | 2139 | -3617 | 1520 | -66 | -3558 | -3681 | -3244 | -3547 | -3164 | -1733 | 2390 | -2634 | -2369 | 361 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 356(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 362 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 357(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 363 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 358(N) | -823 | -1917 | -96 | 1188 | -2187 | -1547 | -506 | -1711 | -265 | 1955 | -1191 | 2711 | -1815 | -144 | -747 | -757 | -815 | 1140 | -2297 | -1666 | 364 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 359(L) | -2153 | -1779 | -4360 | -3884 | -675 | -3965 | -3012 | 392 | -3561 | 2726 | 467 | -3673 | -3662 | -2955 | -3355 | -3239 | -2102 | 1281 | -2207 | -2099 | 365 |
| - | | -149 | -500 | 233 | 43 | -381 | 399 | 106 | -626 | 210 | -466 | -720 | 275 | 394 | 45 | 96 | 359 | 117 | -369 | -294 | -249 | |
| - | | -16 | -7108 | -8150 | -894 | -1115 | -701 | -1378 | * | * | | | | | | | | | | | | |
| 360(E) | 1136 | -2084 | -175 | 2027 | -2436 | -1510 | -274 | -2147 | 1525 | -2118 | -1254 | -175 | -1692 | 152 | -251 | -593 | -670 | -1736 | -2296 | -1650 | 366 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 361(H) | 893 | -1761 | 1357 | 214 | -2092 | -1387 | 1862 | -1810 | 229 | -1825 | -942 | -83 | -1527 | 293 | -273 | 640 | -793 | -1409 | -2050 | -1397 | 367 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 362(I) | 608 | -458 | -2776 | -2176 | 1666 | -2202 | -1113 | 1712 | -1836 | -222 | 338 | -1782 | -2245 | -1512 | -1731 | -1292 | 867 | 1336 | -1036 | -684 | 368 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 363(P) | -922 | -1912 | 1681 | -141 | -2123 | -1604 | -687 | -1787 | -550 | 187 | -1245 | -427 | 2677 | -363 | -1049 | -882 | -947 | -1524 | -2338 | -1711 | 369 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 364(D) | -1692 | -3605 | 3364 | 1256 | -3770 | -1599 | -957 | -3700 | -1216 | -3569 | -2909 | 1025 | -2138 | -628 | -2083 | -1346 | -1761 | -3174 | -3765 | -2738 | 370 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 365(Q) | -877 | -1646 | -633 | 499 | -1610 | -1781 | -505 | -1210 | -63 | 1648 | -649 | -558 | -1931 | 2241 | -360 | -907 | -814 | -1097 | -1882 | -1385 | 371 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 366(P) | -648 | -2019 | 1139 | -203 | -2354 | -1436 | -285 | -2089 | 29 | -2086 | -1217 | -114 | 1965 | 1445 | -492 | -529 | 1244 | -1672 | -2300 | -1616 | 372 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 367(R) | -422 | -1009 | -851 | -304 | 1406 | -1496 | -183 | -740 | 147 | -894 | -230 | -440 | 775 | 21 | 2009 | -539 | -381 | -568 | -1136 | -521 | 373 |
| - | | -149 | -500 | 233 | 43 | -381 | 399 | 106 | -626 | 210 | -466 | -720 | 275 | 394 | 45 | 96 | 359 | 117 | -369 | -294 | -249 | |
| - | | -16 | -7108 | -8150 | -894 | -1115 | -701 | -1378 | * | * | | | | | | | | | | | | |
| 368(D) | 1472 | -1668 | 1835 | -70 | -2356 | -1385 | -511 | -2062 | -246 | -2128 | -1275 | -318 | 1353 | -118 | -746 | -526 | 425 | -1602 | -2380 | -1752 | 374 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 369(G) | -1044 | -2230 | 2141 | -100 | -3222 | 2291 | -982 | -3045 | -1033 | -3050 | -2258 | -395 | -1985 | -644 | -1669 | 858 | -1207 | -2428 | -3250 | -2493 | 375 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 370(Q) | -2562 | -2904 | -1886 | -1971 | -3251 | -2661 | -2079 | -3690 | -1565 | -3469 | -3081 | -2107 | -3091 | 4371 | -1665 | -2585 | -2674 | -3411 | -3077 | -2821 | 376 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 371(D) | -1275 | -2955 | 2862 | 1330 | -3205 | -1556 | -670 | -3029 | 1509 | -2936 | -2141 | -158 | -1955 | -290 | -1213 | -1025 | -1281 | -2554 | -3111 | -2272 | 377 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 372(V) | -1738 | -1298 | -4281 | -3921 | -1737 | -3979 | -3665 | 1917 | -3774 | -601 | -528 | -3671 | -3834 | -3628 | -3843 | -3293 | -1735 | 3205 | -3215 | -2770 | 378 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 373(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 379 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |
| 374(M) | -584 | -1354 | -847 | -246 | -1467 | -1659 | 2505 | -1087 | 212 | -374 | 2571 | -449 | -1729 | 1171 | 1074 | -634 | -507 | -876 | -1617 | -1128 | 380 |
| - | | -149 | -500 | 233 | 43 | -381 | 399 | 106 | -626 | 210 | -466 | -720 | 275 | 394 | 45 | 96 | -359 | 117 | -369 | -294 | -249 | |
| - | | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 375(P) | -910 | -2031 | -73 | 1195 | -2792 | -1488 | -794 | -2539 | -629 | -2588 | -1788 | -401 | 3005 | -439 | -1131 | -612 | -1014 | -2050 | -2815 | -2151 | 381 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 376(W) | -1588 | -1300 | -3783 | -3197 | -329 | -3245 | -1926 | 2071 | -2827 | 1901 | 558 | -2822 | -3072 | -2297 | -2616 | -2381 | -1508 | -111 | 3483 | -1042 | 382 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 377(E) | -1024 | -2640 | 1844 | 2310 | -2908 | -1498 | -505 | -2711 | -344 | -2636 | 1791 | -107 | -1824 | 1521 | -957 | 207 | -1011 | -2243 | -2817 | -2021 | 383 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 378(N) | -826 | -2349 | 1089 | 227 | -2651 | -1487 | -341 | -2416 | 1494 | -2346 | -1475 | 2601 | -1724 | 1005 | -522 | -657 | -787 | -1968 | -2511 | -191 | 384 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 379(P) | 1932 | -1116 | -2232 | -2301 | -3058 | -1358 | -2206 | -2706 | -2336 | -3009 | -2238 | -1674 | 3274 | -2114 | -2406 | -739 | -914 | -1913 | -3260 | -3019 | 385 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 380(V) | -914 | -773 | -2713 | -2129 | -712 | -2505 | -1388 | 1452 | 1084 | 1324 | 204 | -1926 | -2507 | -1580 | -1808 | -1591 | -859 | 1713 | -1424 | -1081 | 386 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 381(Y) | -1484 | -2331 | -1762 | -887 | -2436 | -2254 | -420 | -2325 | 2137 | -2195 | -1475 | -949 | -2258 | -39 | 1983 | -1411 | -1295 | -2075 | -2087 | 2868 | 387 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 382(E) | 1256 | -1890 | -206 | 1353 | -2196 | -1401 | -89 | -1930 | 812 | -1898 | -996 | -45 | 547 | 1252 | -162 | -356 | -414 | -1507 | -2083 | -1416 | 388 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 383(Q) | -752 | -2272 | 1586 | 1407 | -2561 | -1448 | -308 | -2329 | -23 | -2276 | -1396 | -71 | -1677 | 1749 | -577 | -590 | 1569 | -1881 | -2459 | -1727 | 389 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 384(G) | -2594 | -2690 | -3304 | -3623 | -4328 | 3747 | -3462 | -4761 | -3953 | -4671 | -4212 | -3320 | -3352 | -3748 | -3779 | -2839 | -2961 | -4004 | -3668 | -4222 | 390 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 385(H) | -964 | -2089 | -200 | -136 | -2264 | -1600 | 3833 | -2320 | -296 | -2338 | -1558 | 1362 | 1479 | -276 | -699 | -881 | -992 | -1924 | -2364 | -1652 | 391 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 386(L) | -2451 | -1983 | -4707 | -4186 | -582 | -4409 | -3259 | 1510 | -3884 | 2778 | 592 | -4069 | -3865 | -3091 | -3590 | -3698 | -2355 | -150 | -2226 | -2214 | 392 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 387(Q) | 1643 | -1017 | -1196 | -721 | -1189 | -1714 | -668 | 1336 | -497 | -907 | -297 | -823 | -1893 | 2044 | -794 | -784 | -569 | -339 | -1579 | -1135 | 393 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 388(I) | -1760 | -1308 | -4323 | -3961 | -1730 | -4039 | -3721 | 3156 | -3825 | -575 | -512 | -3720 | -3867 | -3669 | -3893 | -3356 | -1753 | 2241 | -3236 | -2802 | 394 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 389(L) | -2871 | -2457 | -4231 | -4103 | -1033 | -3803 | -3165 | -541 | -3734 | 3130 | -31 | -3935 | -3797 | -3286 | -3484 | -3713 | -3869 | -1136 | -2394 | -2220 | 395 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 390(K) | -1259 | -2115 | -1267 | -676 | -970 | -2105 | -1794 | -2040 | 2549 | -1955 | -1282 | -808 | -2165 | -167 | 114 | -1192 | -1140 | -1801 | -1301 | 2517 | 396 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 391(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 397 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 392(N) | -2171 | -3655 | -1458 | -1748 | -3334 | -2364 | -2267 | -3943 | -2365 | -3936 | -3437 | 4205 | -2932 | -2205 | -2608 | -2224 | -2439 | -3392 | -3253 | 2909 | 398 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 393(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 399 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 394(A) | 3121 | -934 | -2489 | -2561 | -3081 | -1203 | -2295 | -2766 | -2533 | -3080 | -2234 | -1669 | -1953 | -2234 | -2533 | 936 | -746 | -1844 | -3331 | -3090 | 400 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 395(E) | -522 | -1773 | -240 | 1676 | -2248 | -1396 | -289 | -1968 | 50 | -1989 | -1115 | -174 | -1198 | 131 | -448 | 1226 | 677 | -1538 | -2214 | -1565 | 401 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 396(E) | -1481 | -3230 | 1425 | 2936 | -3481 | 751 | -843 | -3354 | -954 | -3256 | -2520 | -187 | -2057 | -492 | -1711 | -1193 | -1527 | -2852 | -3445 | -2523 | 402 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 397(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 403 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 398(A) | 2847 | -932 | -2454 | -2477 | -3066 | -1198 | -2236 | -2763 | -2439 | -3057 | -2202 | -1635 | -1940 | -2152 | -2471 | 1777 | -731 | -1840 | -3306 | -3056 | 404 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 399(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 405 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 400(A) | 3438 | -1472 | -2846 | -3040 | -3287 | -1726 | 2735 | -2840 | -3028 | -3257 | -2662 | -2236 | -2447 | -2798 | -2944 | -1216 | -1387 | -2183 | -3405 | -3320 | 406 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 401(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 407 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 402(I) | -1761 | -1312 | -4317 | -3954 | -1713 | -4027 | -3703 | 3225 | -3814 | -556 | -498 | -3712 | -3859 | -3653 | -3877 | -3344 | -1754 | 2110 | -3216 | -2787 | 408 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 403(S) | -348 | -981 | -2200 | -2194 | -2989 | -1227 | -2073 | -2686 | -2157 | -2970 | -2136 | -1541 | -1946 | -1946 | -2253 | 3060 | 1398 | -1824 | -3217 | -2916 | 409 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 404(G) | -2594 | -2690 | 3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 410 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 405(V) | -917 | -809 | -2556 | -1976 | -827 | -2491 | -1367 | 1339 | 1455 | 721 | 94 | -1841 | -2501 | -1487 | -1710 | -1570 | -863 | 2038 | -1514 | -1151 | 411 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 406(K) | -1386 | -2643 | -447 | 1824 | -3108 | -1893 | -570 | 2752 | 2860 | -2616 | -1848 | -552 | -2117 | -166 | -3 | -1217 | -1300 | -2388 | -2647 | -2154 | 412 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | |
|---|---|---|---|---|---|---|---|---|---|---|---|---|---|---|---|---|---|---|---|
| 407(N) | -537 | -1563 | -449 | -36 | -1889 | 1143 | -307 | -1529 | 932 | -1655 | -844 | 1794 | -1658 | 73 | -356 | -518 | -516 | 924 | -1962 | -1392 | 413 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 408(P) | -894 | -2181 | -369 | 1705 | -2576 | -1650 | -357 | -2268 | 243 | -2210 | -1375 | -330 | 2093 | 63 | 1619 | -774 | -835 | -1876 | -2347 | -1769 | 414 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 409(V) | -419 | -634 | -1376 | -807 | 1053 | -1737 | -499 | -198 | -623 | -505 | 178 | 600 | -1807 | -475 | 475 | 313 | -360 | 1389 | -1016 | 1303 | 415 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 410(I) | -1282 | -1082 | -3022 | -2555 | 2426 | 2683 | 1767 | 2555 | -2191 | -443 | -88 | -2038 | -2692 | -1794 | -2075 | -1793 | -1220 | -317 | -361 | 552 | 416 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 411(T) | -499 | -1595 | -431 | 966 | -1830 | -1487 | -185 | -1449 | -1092 | -1574 | -754 | -207 | -1601 | 213 | -206 | -458 | 2067 | 159 | -1877 | -1296 | 417 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 412(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 418 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 413(P) | -632 | -1230 | -2074 | -2144 | -2996 | -1453 | -2116 | -2631 | -2128 | -2928 | -2213 | -1658 | 3610 | -2006 | -2221 | -852 | 1302 | -1931 | -3185 | -2917 | 419 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 414(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 420 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 415(R) | -1454 | -2316 | -1780 | -878 | -2834 | -2232 | -428 | -2292 | 2281 | -2200 | -1473 | -940 | -2240 | -17 | 2627 | -1386 | -1270 | 588 | -2249 | -1960 | 421 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 416(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 422 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 417(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 423 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 418(D) | -1572 | -3426 | 2573 | 2447 | -3613 | -1583 | -879 | -3513 | -1050 | -3393 | -2684 | 1292 | -2085 | -535 | -1855 | -1253 | -1623 | -3000 | -3585 | -2609 | 424 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 419(S) | -879 | -1989 | 1498 | -177 | -3045 | 1600 | -939 | -2843 | -904 | -2867 | -2046 | -438 | -1922 | -591 | -1483 | 2171 | -1044 | -2226 | -3072 | -2372 | 425 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 420(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 426 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 421(Q) | -705 | -1925 | -199 | 2112 | 917 | -1534 | -288 | -1824 | 42 | -1842 | -1054 | -210 | -1709 | 2163 | -420 | -611 | -656 | -1502 | -1997 | -1291 | 427 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 422(H) | -569 | -2048 | 1450 | 1526 | -2349 | -1405 | 1830 | -2103 | 181 | -2058 | -1157 | -37 | -1569 | 272 | -349 | 713 | 620 | -1662 | -2240 | -1537 | 428 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 423(C) | 1626 | 2878 | -2671 | -2107 | 1264 | -1968 | -1091 | 233 | -1777 | -334 | 250 | -1672 | -2128 | -1459 | -1691 | -1096 | -529 | 1209 | -1066 | -704 | 429 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 424(M) | -2042 | -1534 | -4379 | -3826 | -659 | -3976 | -2899 | 2765 | -3546 | 1204 | 3085 | -3605 | -3604 | -2896 | -3318 | -3183 | -1961 | 195 | -2135 | -2058 | 430 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 425(E) | 412 | -2447 | 1356 | 2379 | -2747 | -1477 | -445 | -2527 | -243 | -2477 | -1622 | -107 | 855 | -36 | -831 | -731 | -894 | -2073 | -2668 | -1906 | 431 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 426(A) | 2822 | -1031 | -2418 | -2539 | -3226 | 1898 | -2364 | -2941 | -2626 | -3229 | -2379 | -1722 | -2026 | -2302 | -2634 | -654 | -848 | -1983 | -3415 | -3226 | 432 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 427(I) | -1772 | -1325 | -4307 | -3877 | -1405 | -3993 | -3383 | 2935 | -3705 | 820 | -217 | -3632 | -3761 | -3400 | -3682 | -3260 | -1742 | 2033 | -2838 | -2525 | 433 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 428(L) | -875 | -1534 | -575 | -959 | -1581 | -1769 | -525 | -1179 | -135 | 1884 | -625 | -547 | -1931 | 1405 | -450 | -909 | -816 | -1074 | -1883 | -1383 | 434 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 429(A) | 1705 | -1826 | -180 | 949 | -2318 | -1410 | -359 | -2041 | -53 | -2067 | -1204 | 1001 | -1652 | 52 | -561 | 1232 | -595 | -1609 | -2298 | -1643 | 435 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 430(D) | -1074 | -2458 | 2381 | 60 | -2921 | 1927 | -658 | -2710 | -463 | -2675 | -1860 | -271 | -1918 | -276 | 866 | -915 | -1100 | -2245 | -2845 | -2124 | 436 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 431(K) | -688 | -2117 | 785 | 888 | -2469 | -1529 | -187 | -2187 | 2380 | -2106 | -1221 | -162 | -1661 | 256 | 1134 | -553 | -619 | -1760 | -2240 | -1607 | 437 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 432(I) | -2019 | -1582 | -4380 | -3941 | -1000 | -4086 | -3253 | 3295 | -3674 | 1100 | 145 | -3736 | -3783 | -3222 | -3556 | -3378 | -1976 | 657 | -2517 | -2289 | 438 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 433(Q) | -490 | -1797 | -369 | 171 | -2078 | -1457 | 1762 | -1779 | -1157 | -1780 | -905 | 1165 | -1550 | 1798 | -48 | -396 | -422 | 725 | -1986 | -1366 | 439 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 434(A) | 1954 | -1835 | 1733 | -180 | -2714 | -1429 | -806 | -2438 | -679 | -2518 | -1698 | -430 | 1775 | -448 | -1211 | -736 | -894 | -1923 | -2765 | -2117 | 440 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 435(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 441 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 436(D) | -1736 | -3455 | 3490 | 97 | -3737 | -1646 | -1070 | -3753 | -1363 | -3647 | -3016 | 1602 | -2204 | -760 | -2218 | -1420 | -1838 | -3213 | -3756 | -2780 | 442 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 437(V) | -1721 | -1302 | -4229 | -3874 | -1705 | -3894 | -3582 | 1607 | -3706 | -582 | -513 | -3610 | -3786 | -3559 | -3767 | -3209 | -1725 | 3294 | -3158 | -2712 | 443 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 438(V) | -594 | -988 | -3391 | -2911 | -1164 | -2888 | -2187 | 845 | -2637 | 765 | -154 | -2576 | -2962 | -2387 | -2622 | -2074 | -1205 | 2800 | -2084 | -1724 | 444 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 439(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 445 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 440(I) | -1754 | -1308 | -4295 | -3867 | -1434 | -3978 | -3377 | 2661 | -3697 | 862 | -247 | -3617 | -3754 | -3406 | -3679 | -3243 | -1725 | 2373 | -2852 | -2526 | 446 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 441(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 447 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 442(Y) | -1321 | -1438 | -1994 | -1608 | 2186 | 527 | -450 | -1117 | -1481 | -1211 | -693 | 1178 | -2522 | -1217 | -1665 | -1518 | -1275 | -1021 | -198 | 3178 | 448 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 443(C) | -675 | 2205 | -2544 | 972 | -572 | -2236 | -1121 | 1317 | -1671 | 679 | 261 | -1700 | -2270 | -1403 | -1668 | -1311 | -621 | 1601 | -1150 | -790 | 449 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 444(G) | -2594 | -2960 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 450 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 445(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 451 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 446(K) | -1060 | -2058 | -1088 | -460 | -2432 | -1917 | -357 | -1970 | 2801 | -1978 | -1220 | -632 | -1990 | 1339 | 367 | -999 | -946 | 536 | -2145 | -1717 | 452 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 447(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 453 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 448(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 454 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 449(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 455 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 450(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 456 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 451(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 457 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 452(P) | -1659 | -2241 | -2022 | -1646 | -3185 | -2242 | -1373 | -3000 | -450 | -2936 | -2274 | -1624 | 3435 | -1065 | 2095 | -1730 | -1750 | -2593 | -2816 | -2613 | 458 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 453(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 459 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 454(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 460 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 455(L) | -2871 | -2457 | -4231 | -4103 | -1033 | -3803 | -3165 | -541 | -3734 | 3130 | -31 | -3035 | -3797 | -3286 | -3484 | -3713 | -2869 | -1136 | -2394 | -2220 | 461 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 456(K) | 1368 | -1491 | -763 | -332 | -2319 | -1417 | -551 | -1998 | 1786 | -2068 | -1221 | -500 | -1721 | -160 | -470 | 1631 | -587 | -1532 | -2299 | -1754 | 462 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 457(P) | -1500 | -1738 | -2514 | -2380 | -1555 | -2358 | -2022 | -1126 | -2063 | 1224 | -841 | -2189 | 3436 | -2061 | -2129 | -1822 | -1674 | -1231 | -2290 | -1878 | 463 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 458(T) | -351 | -974 | -2208 | -2185 | -2894 | -1237 | -2041 | -2561 | -2125 | -2863 | -2046 | -1539 | -1948 | -1923 | -2218 | 1543 | 3230 | -1758 | -3139 | -2834 | 464 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 459(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 465 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 460(M) | 2706 | -986 | -2433 | -2144 | -1502 | -1684 | -1706 | -700 | -1858 | -968 | 2744 | -1705 | -2188 | -1713 | -1932 | -963 | -862 | -592 | -2145 | -1794 | 466 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 461(I) | -2103 | -1659 | -4461 | -3992 | -869 | -4152 | -3233 | 3082 | -3723 | 1619 | 290 | -3801 | -3788 | -3171 | -3557 | -3432 | -2046 | 487 | -2418 | -2265 | 467 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 462(I) | -1761 | -1312 | -4317 | -3954 | -1713 | -4027 | -3703 | 3225 | -3814 | -556 | -498 | -3712 | -3859 | -3653 | -3877 | -3344 | -1754 | 2110 | -3216 | -2787 | 468 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 463(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 469 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 464(K) | 1641 | -2033 | -323 | 914 | -2415 | -1565 | -296 | -2097 | 2052 | -2080 | -1233 | -257 | -1736 | 125 | -133 | -646 | -702 | -1707 | -2258 | -1657 | 470 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 465(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 471 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 466(L) | -1699 | -1807 | -2268 | -1925 | -830 | -2795 | -1551 | -455 | -1225 | 2510 | 90 | -1958 | -2845 | 1927 | -1308 | -2067 | -1651 | -846 | -1841 | -1454 | 472 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 467(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 473 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 468(D) | -853 | -2415 | 2115 | 1717 | -2702 | -1468 | -378 | -2484 | 1085 | -2417 | -1546 | -84 | -1732 | 41 | -699 | 696 | -824 | -2025 | -2594 | -1839 | 474 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 469(S) | -892 | -1780 | -931 | -688 | -2757 | -1643 | -830 | -2472 | 1671 | -2492 | -1708 | -799 | -2018 | -468 | -365 | 2676 | -1004 | -1981 | -2598 | -2130 | 475 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 470(C) | -1135 | 3503 | -3700 | -3406 | -1670 | -2549 | -2675 | 653 | -3101 | -916 | -667 | -2727 | -2925 | -2870 | -3030 | -1868 | -1288 | 2927 | -2619 | -2222 | 476 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| 471(A) | 2590 | -1035 | -2404 | -2530 | -3236 | 2290 | -2365 | -2954 | -2627 | -3240 | -2389 | -1719 | -2027 | -2302 | -2637 | -656 | -851 | -1991 | -3423 | -3234 | 477 |
|---|---|---|---|---|---|---|---|---|---|---|---|---|---|---|---|---|---|---|---|---|---|
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 472(L) | -2632 | -2152 | -4630 | -4185 | 1767 | -4324 | -2442 | -61 | -3879 | 2789 | 563 | -3833 | -3823 | -2970 | -3513 | -3609 | -2518 | -738 | -1527 | -945 | 478 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 473(I) | -2073 | -1632 | -4434 | -3975 | -911 | -4130 | -3238 | 3164 | -3706 | 1451 | 244 | -3779 | -3785 | -3187 | -3557 | -3413 | -2021 | 546 | -2449 | -2273 | 479 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 474(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 480 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 475(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 481 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 476(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 482 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 477(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 483 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 478(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 484 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| 479(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 485 |
|---|---|---|---|---|---|---|---|---|---|---|---|---|---|---|---|---|---|---|---|---|---|
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 480(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 486 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 481(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 487 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 482(T) | -359 | -976 | -2225 | -2229 | -2900 | -1242 | -2074 | -2560 | -2170 | -2875 | -2064 | -1561 | -1958 | -1969 | -2247 | 1110 | 3375 | -1760 | -3152 | -2850 | 488 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 483(Y) | -3402 | -2632 | -3941 | -4011 | 1064 | -3924 | 3388 | -2526 | -3541 | -1996 | -1973 | -2625 | -3821 | -2664 | -3170 | -3135 | -3280 | -2619 | 3420 | 3756 | 489 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 484(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 490 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 485(M) | -2322 | -1904 | -4536 | -3951 | 2387 | -4112 | -2676 | 67 | -3649 | 2034 | 3156 | -3710 | -3633 | -2803 | -3311 | -3309 | -2204 | -588 | -1794 | -1586 | 491 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 486(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 492 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | | |
|---|---|---|---|---|---|---|---|---|---|---|---|---|---|---|---|---|---|---|---|---|---|
|487(V)|-1771|-1603|-3750|-3689|-2037|-3050|-3231|403|-3479|-1154|-1076|-3246|-3399|-3383|-3437|-2628|-1917|3536|-3074|-2677|493|
|-|-149|-500|233|43|-381|399|106|-626|210|-466|-720|275|394|45|96|359|117|-369|-294|-249| |
|-|-16|-7108|-8150|-894|-1115|-701|-1378|*|*| | | | | | | | | | | | |
|488(G)|-2594|-2690|-3304|-3623|-4328|3747|-3462|-4761|-3953|-4671|-4212|-3320|-3352|-3748|-3779|-2839|-2981|-4004|-3668|-4222|494|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|489(H)|-3205|-3079|-2723|-2890|-2110|-3046|5295|-4135|-2617|-3813|-3561|-2886|-3482|-2833|-2620|-3291|-3356|-3895|-2397|-1681|495|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|490(V)|-1754|-1297|-4329|-3968|-1770|-4053|-3752|2604|-3840|-621|-545|-3728|-3878|-3699|-3917|-3370|-1746|2859|-3276|-2829|496|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|491(A)|2587|-828|-2477|-2155|-1837|-1468|-1728|-743|-1941|-1564|-954|-1607|-2033|-1725|-2034|-738|1178|1108|-2310|-1972|497|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|492(P)|-2931|-2878|-3420|-3706|-4181|-2925|-3468|-4621|-3859|-4490|-4165|-3491|4225|-3781|-3695|-3182|-3279|-4087|-3594|-4064|498|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|493(E)|-2641|-3308|-896|3732|-3966|-2458|-2043|-4105|-2128|-4016|-3555|-1531|-2959|-1842|-2560|-2479|-2750|-3722|-3563|-3385|499|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|494(A)|3438|-1472|-2846|-3040|-3287|-1726|-2735|-2840|-3028|-3257|-2662|-2236|-2447|-2798|-2944|-1216|-1387|-2183|-3405|-3320|500|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|495(Y)|-866|-976|-1863|-1331|1353|-2145|1318|-556|-1116|-777|-173|-1242|-2197|1714|-1301|-1173|-802|888|-445|2749|501|
|-|-149|-500|233|43|-381|399|106|-626|210|-466|-720|275|394|45|96|359|117|-369|-294|-249| |
|-|-16|-7108|-8150|-894|-1115|-701|-1378|*|*| | | | | | | | | | | | |
|496(D)|417|-1831|1647|1094|-2065|-1488|-353|-1618|-107|-1820|-1019|-189|-1698|30|-623|-603|-643|1629|-2154|-1520|502|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|497(G)|-2594|-2690|-3304|-3623|-4328|3747|-3462|-4761|-3953|-4671|-4212|-3320|-3352|-3748|-3779|-2839|-2981|-4004|-3668|-4222|503|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|498(G)|-2594|-2690|-3304|-3623|-4328|3747|-3462|-4761|-3953|-4671|-4212|-3320|-3352|-3748|-3779|-2839|-2981|-4004|-3668|-4222|504|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|499(T)|492|-1190|-706|-181|-1475|311|-333|-1099|-81|71|-509|570|1113|-6|-509|-450|1123|-835|-1680|-1161|505|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|500(I)|-2091|-1746|-3971|-3840|-1676|-3532|-3289|3684|-3581|-659|-693|-3562|-3674|-3445|-3521|-3194|-2146|449|-2877|-2493|506|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|501(A)|3103|-1036|-2445|-2572|-3222|1051|-2380|-2930|-2650|-3226|-2381|-1739|-2034|-2327|-2648|-664|-857|-1981|-3412|-3228|507|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |
|502(L)|-2239|-1892|-3711|-3400|301|-3520|-1210|-542|-2948|2564|-35|-2786|-3395|-2438|-2750|-2747|-2165|-945|-573|2562|508|
|-|-149|-500|233|43|-381|399|106|-626|210|-466|-720|275|394|45|96|-359|117|-369|-294|-249| |
|-|-16|-7108|-8150|-894|-1115|-701|-1378|*|*| | | | | | | | | | | | |

TABLE 1-continued

| 503(V) | -1757 | -1387 | -4101 | -3681 | -1174 | -3714 | -3031 | 880 | -3410 | 1254 | -60 | -3407 | -3585 | -3094 | -3354 | -2984 | -1743 | 3014 | -2536 | -2219 | 509 |
|---|---|---|---|---|---|---|---|---|---|---|---|---|---|---|---|---|---|---|---|---|---|
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 504(Q) | -982 | -2251 | -866 | 971 | -2711 | -1822 | -252 | -2340 | 1444 | -2194 | -1356 | -464 | -1885 | 2646 | 1632 | -858 | -863 | -1958 | -2245 | -1765 | 510 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 505(E) | -1162 | -2771 | 2137 | 2239 | -3046 | -1526 | -626 | -2849 | -546 | -2792 | -1983 | -145 | -1905 | -242 | -1192 | -940 | 1396 | -2385 | -2990 | -2169 | 511 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 506(G) | -1707 | -2684 | 1591 | -614 | -3783 | 3190 | -1613 | -3795 | -1887 | -3775 | -3119 | -915 | -2456 | -1359 | -2539 | -1610 | -1924 | -3150 | -3636 | -3124 | 512 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 507(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 513 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 508(M) | -473 | -522 | -1819 | -1236 | -468 | -1879 | -687 | 1519 | -996 | 566 | 1677 | -1154 | -1937 | 836 | -1131 | 1079 | -413 | 102 | -957 | -585 | 514 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 509(I) | -1761 | -1312 | -4317 | -3954 | -1713 | -4027 | -3703 | 3225 | -3814 | -556 | -498 | -3712 | -3859 | -3653 | -3877 | -3344 | -1754 | 2110 | -3216 | -2787 | 515 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 510(T) | 782 | -1467 | -550 | 1029 | -2202 | -1425 | -709 | -1791 | -472 | -1993 | -1203 | -528 | -1787 | -368 | -902 | -617 | 2685 | -1400 | -2333 | -1783 | 516 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| 511(V) | -1766 | -1333 | -4283 | -3923 | -1635 | -3967 | -3619 | 3388 | -3759 | -473 | -437 | -3672 | -3822 | -3576 | -3804 | -3285 | -1764 | 1695 | -3126 | -2717 | 517 |
|---|---|---|---|---|---|---|---|---|---|---|---|---|---|---|---|---|---|---|---|---|---|
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 512(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 518 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 513(A) | 2705 | -1451 | -1036 | -913 | -2506 | -1504 | -1143 | -2174 | -794 | -2337 | -1613 | -946 | -1993 | -2040 | -1061 | -809 | -910 | -1703 | -2633 | -2156 | 519 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 514(H) | -615 | -1680 | 1444 | 66 | -1883 | 168 | 2650 | -1558 | -86 | 1691 | -891 | -223 | -1680 | 31 | -577 | -571 | -585 | -1267 | -2007 | -1397 | 520 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 515(K) | -654 | -2006 | -546 | 42 | -2376 | -1581 | -133 | -2066 | 1935 | -1987 | -1107 | 1132 | 1658 | 1043 | 1058 | -540 | 1180 | -1660 | -2113 | -1532 | 521 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 516(N) | -933 | -2085 | -946 | -284 | -2472 | -1822 | -253 | -2090 | 1711 | 76 | -1204 | 1918 | -1876 | 175 | 1799 | -841 | -817 | -1755 | -2132 | -1663 | 522 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 517(E) | -416 | -987 | -843 | 1107 | -1070 | -1583 | -338 | -623 | -183 | 879 | -172 | -489 | -1679 | -94 | -565 | -544 | 813 | 265 | -1379 | -905 | 523 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 518(I) | -2258 | -1804 | -4588 | -4084 | -706 | -4269 | -3231 | 2527 | -3807 | 2292 | 465 | -3923 | -3814 | -3118 | -3570 | -3544 | -2181 | 190 | -2303 | -2237 | 524 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 519(Q) | -477 | -1909 | 958 | 282 | -2211 | -1389 | 1484 | -1953 | 285 | -1921 | -1018 | -32 | -1517 | 2318 | -225 | 630 | 559 | -1525 | -2110 | -1430 | 525 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 520(L) | -2127 | -1743 | -4402 | -3796 | 1257 | -3918 | -2674 | 149 | -3492 | 2527 | 2164 | -3553 | -3509 | -2714 | -3181 | -3095 | -2019 | 570 | -1870 | -1818 | 526 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 521(N) | -723 | -2217 | 958 | 236 | -2518 | -1466 | 1611 | -2279 | 1719 | -2217 | -1334 | 2285 | -1666 | 166 | -401 | -570 | -677 | -1837 | -2382 | -1678 | 527 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 522(V) | -1754 | -1297 | -4330 | -3968 | -1770 | -4053 | -3752 | 2623 | -3841 | -620 | -545 | -3729 | -3878 | -3699 | -3918 | -3371 | -1746 | 2846 | -3277 | -2830 | 528 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 523(S) | 1545 | -974 | -2003 | -1825 | -2867 | -1206 | -1790 | -2580 | -1788 | -2795 | -1932 | -1362 | 1826 | -1586 | -1999 | 2362 | -672 | -1755 | -3057 | -2721 | 529 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 524(D) | -1776 | -3649 | 3326 | 1869 | -3838 | -1642 | -1031 | -3788 | -1322 | -3660 | -3029 | -245 | -2192 | -711 | -2201 | -1425 | -1855 | -3264 | -3821 | -2816 | 530 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 525(E) | 423 | -2950 | 1944 | 2696 | -3223 | -1545 | -718 | -3047 | -715 | -2979 | -2196 | -161 | -1968 | -347 | -1403 | -1043 | -1314 | -2569 | -3177 | -2316 | 531 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 526(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 532 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 527(L) | -2339 | -1899 | -4618 | -4042 | 1570 | -4204 | -2849 | 1440 | -3758 | 2558 | 676 | -3825 | -3700 | -2902 | -3418 | -3418 | -2226 | -382 | -1924 | -1778 | 533 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 528(A) | 2338 | -1990 | -241 | 938 | -2395 | -1557 | -423 | -2061 | 954 | -2103 | -1286 | -301 | -1791 | -26 | -375 | -717 | -784 | -1691 | -2330 | -1728 | 534 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 529(R) | 524 | -2098 | -789 | -146 | -2504 | -1729 | 1632 | -2153 | 1229 | -2054 | -1204 | -379 | -1789 | 1328 | 2313 | -719 | -724 | -1774 | -2150 | -1637 | 535 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 530(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 536 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 531(R) | -1895 | -2713 | -2327 | -1192 | -3484 | -2502 | -481 | -2856 | 2144 | -2544 | -1842 | -1161 | -2458 | 1393 | 3023 | -1770 | -1619 | -2599 | -2421 | -2259 | 537 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 532(A) | 2935 | -1714 | -553 | 857 | -2769 | -1546 | -1218 | -2333 | -1106 | -2591 | -1873 | -809 | -2065 | -934 | -1502 | -954 | -1103 | -1872 | -2898 | -2374 | 538 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 533(A) | 1291 | -1874 | -176 | 1227 | -2177 | -1392 | -109 | -1909 | 277 | -1891 | -995 | 1134 | -1522 | 1248 | -228 | -361 | 562 | -1492 | -2090 | -1419 | 539 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 534(W) | -805 | -687 | -2581 | -2028 | 138 | -2236 | -697 | -897 | -1681 | -421 | 141 | -1645 | -2282 | -1369 | -1627 | -1315 | 636 | -90 | 4479 | 1809 | 540 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 535(H) | -408 | -1801 | -274 | 1284 | -2096 | -1385 | 1500 | -1822 | 1168 | -1802 | -899 | -33 | -1479 | 1381 | -102 | -303 | 595 | 221 | -1996 | -1339 | 541 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 536(Q) | -650 | -1737 | -627 | -72 | -1981 | -1615 | -209 | -1625 | 1223 | -392 | -866 | -318 | 1222 | 2120 | 50 | -598 | -572 | -1326 | -1932 | -1394 | 542 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 537(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 543 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 538(A) | 2195 | -924 | -968 | -546 | -1397 | -1356 | -583 | -812 | -365 | -1167 | -487 | -618 | -1660 | 1324 | -684 | -483 | -404 | 462 | -1703 | -1242 | 544 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 539(P) | 411 | -1017 | -1886 | -1616 | -1600 | -1588 | -1411 | -962 | -1408 | 495 | -755 | -1384 | 3156 | -1323 | -1577 | -847 | -785 | -783 | -2111 | -1716 | 545 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 540(R) | -1612 | -2397 | -2037 | -1033 | -2897 | -2352 | -458 | -2365 | 2184 | 665 | -1520 | -1051 | -2334 | -51 | 2602 | -1545 | -1395 | -2143 | -2262 | -2014 | 546 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 541(Y) | 712 | -796 | -2334 | -1883 | -370 | -2028 | -986 | -143 | -1607 | -663 | -131 | -1587 | -2243 | -1383 | -1656 | -1178 | -771 | 1114 | -965 | 3479 | 547 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 542(T) | -527 | -1669 | 1091 | -27 | -2315 | -1379 | -443 | -2033 | -151 | -2081 | -1218 | -282 | 557 | -41 | -650 | 1128 | 2077 | -1576 | -2321 | -1690 | 548 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

| | | | | | | | | | | | | | | | | | | | | |
|---|---|---|---|---|---|---|---|---|---|---|---|---|---|---|---|---|---|---|---|---|
| 543(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 549 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 544(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 550 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 545(V) | -1747 | -1296 | -4310 | -3948 | -1758 | -4023 | -3716 | 2215 | -3813 | -615 | -540 | -3705 | -3860 | -3670 | -3887 | -3339 | -1741 | 3087 | -3252 | -2806 | 551 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 546(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 552 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 547(A) | 2404 | -890 | -1926 | -1629 | -1803 | 1275 | -1415 | -1282 | -1490 | 392 | -963 | -1316 | -1930 | -1328 | -1674 | -654 | -644 | -952 | -2187 | -1810 | 553 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 548(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 554 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 549(Y) | -3621 | -2707 | -4176 | -4424 | 2950 | -4049 | -394 | -2539 | -4002 | -1942 | -1987 | -2749 | -3933 | -2854 | -3451 | -3299 | -3499 | -2690 | 349 | 4094 | 555 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 550(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 556 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |

TABLE 1-continued

| | | | | | | | | | | | | | | | | | | | | |
|---|---|---|---|---|---|---|---|---|---|---|---|---|---|---|---|---|---|---|---|---|
| 551(H) | -1741 | -2627 | -2070 | -1046 | -3303 | -2401 | 2713 | -2751 | -2478 | -2476 | -1755 | -1061 | -2375 | -27 | 2379 | -1621 | -1497 | -2477 | -2379 | -2161 | 557 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 552(L) | -1014 | -876 | -2956 | -2408 | -582 | -2550 | -1529 | 1721 | -2079 | 2042 | 345 | -2114 | -2581 | -1775 | -2028 | 454 | -980 | 286 | -1414 | -1096 | 558 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 553(V) | 933 | -842 | -2818 | -2467 | -1542 | -1870 | -1890 | 154 | -2226 | -1095 | -617 | -1932 | -2326 | -1995 | -2259 | -1126 | 1070 | 2769 | -2180 | -1826 | 559 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 554(S) | -787 | -1522 | -1486 | -1172 | -2714 | -1599 | -1112 | -2500 | -433 | -2563 | -1791 | -1110 | -2067 | -796 | 1351 | 2916 | -989 | -1943 | -2648 | -2234 | 560 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 555(S) | -326 | -1010 | -1779 | -1541 | -2691 | -1234 | -1566 | -2386 | -1486 | -2594 | -1749 | -1228 | 1196 | -1330 | -1747 | 2398 | 1967 | -1662 | -2876 | -2496 | 561 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 556(A) | 3121 | -934 | -2489 | -2561 | -3081 | -1203 | -2295 | -2766 | -2533 | -3080 | -2234 | -1669 | -1953 | -2234 | -2533 | 936 | -746 | -1844 | -3331 | -3090 | 562 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 557(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 563 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 558(R) | -586 | -1873 | -516 | 979 | -2188 | -1543 | -123 | -1869 | 1290 | -353 | -980 | -202 | -1622 | 314 | 1886 | -491 | 782 | -1495 | -2024 | -1439 | 564 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 559(G) | -2459 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 565 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 560(C) | 2804 | 3772 | -3185 | -3198 | -2739 | -1303 | -2462 | -2065 | -2882 | -2628 | -1924 | -1927 | -2044 | -2547 | -2727 | -661 | -799 | -1463 | -3099 | -2886 | 566 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 561(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -3677 | 567 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 562(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 568 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 563(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 569 |
| - | -149 | -500 | 233 | 43 | -381 | 399 | 106 | -626 | 210 | -466 | -720 | 275 | 394 | 45 | 96 | -359 | 117 | -369 | -294 | -249 | |
| - | -16 | -7108 | -8150 | -894 | -1115 | -701 | -1378 | * | * | | | | | | | | | | | | |
| 564(F) | -525 | -445 | -2202 | -1627 | 1946 | -2001 | -744 | 1247 | -1346 | 952 | 561 | 1079 | -2030 | -1067 | -1362 | -1067 | -465 | 338 | -714 | -230 | 570 |
| - | * | * | * | * | * | * | * | * | * | * | * | * | * | * | * | * | * | * | * | * | |
| - | * | * | * | * | * | * | * | * | 0 | | | | | | | | | | | | |

SEQUENCE LISTING (618 sequences)

SEQ ID NO: 1 - DNA, 1743 bp, Mycobacterium sp.
atgccctcaggaagttcaggaactcccgctgatgctcttcgcgcgagcgactcatcgccggacatcaagccccgcagccgcgacgtcaccgacggcctcgagaagaccgccgcccgcgggatgctgcgggcggtcggcatgggcgacgacgactgggtcaaaccgcagatcggcgtgggttcgtcgtggaacgagatcaccccgtgcaacatgtcgctgcaacggctggcgcagtcggtgaagggcggcgtgcactccgccggcggatttccgctggagttcggcacgatctcggtgtccgacggcatctcgatgggccacgagggcatgcacttctcgctggtctcgcgtgaggtgatcgccgacagcgtcgagaccgtcgtgcaggccgagcgtctcgacggcacggtgctgctggccggctgcgacaagtcgattcccggcatgctgatggccgccgcccggctcgacctggcctcggtcttcctgtacaacggttcgatcatgccgggcgtcgcgaagctcaccgacggctccgagcgggaagtcacgatcatcgacgccttcgaggcggtcggggcgtgcgcccgcgggctgatgtcccgcgaggacgtcgacatcatcgaacgggcgatctgtccgggtgagggcgcctgcggcggtatgtacaccgccaacaccatggcgtcggcggcggaagcgctcggcatgtcgttgccgggcagcgcatctcctgtggccatcgacaagcggcgcgacgagtacgcgcggaagtcgggtgaggcggtcgtcgagatgctgcgccgcggtatcaccgcccgcgacatcctcaccaaggaggccttcgagaacgcgatcgccgtcgtcatggcgttcggcggctccaccaacgccgtgctgcacctgctggccatcgcgtgggaggccaacgtgaagctcaccctcgaggacttcacccgcgtcgggcagaaggtgccgcacctcgccgacgtcaaaccgttcggccgtcacgtcatgaagcacgtcgacgagatcggcggtgtgcccgtggtgatgaaggcgctgctggacgccggactgctgcacggggactgcctcaccatcaccggcgagaccatggccgagaacctggcccacatcgaaccgccggacccggacggcaaggtgctgcgggcgatgaacaacccgatccacccgaccggcggcatcacgatcctgcacggatcgttggcgcccgagggcgcggtcgtgaagtcggcgggcttcgactccgacgtgttcgagggcaccgcaagggttttcgagcgggagcgggcagccctggacgcactcgaggacggcacgatcacccacggcgacgtcgtcgtcatccgctacgagggacccaagggcgggcccgggatgcgcgagatgctcgccatcaccggtgcgatcaagggtgccggcctgggcaaggacgtgctgctgatgaccgacggccggttctccggcggcaccaccggcctgtgcgtcgggcatatcgcccccgaggcggtcgacggcgggcccatcgcgttcgtgcgcgacggcgaccggatccggctcgacgtcgccaagggcacgctggacctcctggtcgacgaggccgaattcgagtcccgcaaagcgggattcgagccgttgcccccggtgtacaccaccggcgtgctggccaagtacacgaagttggtcgggtcggcggcggtcggcgcggtctgcggctag

SEQ ID NO: 2 - protein, 580 aa, Mycobacterium sp.
MPSGSSGTPADALRASDSSPDIKPRSRDVTDGLEKTAARGMLRAVGMGDDDWVKPQIGVGSSWNEITPCNMSLQRLAQSVKGGVHSAGGFPLEFGTISVSDGISMGHEGMHFSLVSREVIADSVETVVQAERLDGTVLLAGCDKSIPGMLMAAARLDLASVFLYNGSIMPGVAKLTDGSEREVTIIDAFEAVGACARGLMSREDVDIIERAICPGEGACGGMYTANTMASAAEALGMSLPGSASPVAIDKRRDEYARKSGEAVVEMLRRGITARDILTKEAFENAIAVVMAFGGSTNAVLHLLAIAWEANVKLTLEDFTRVGQKVPHLADVKPFGRHVMKHVDEIGGVPVVMKALLDAGLLHGDCLTITGETMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVAKGTLDLLVDEAEFESRKAGFEPLPPVYTTGVLAKYTKLVGSAAVGAVCG

SEQ ID NO: 3 - DNA, 1770 bp, Mycobacterium gilvum
atgtggccgatgaatcgacgggcgcataatcaccccatgccctcagactcacgctcgcattctcttcgcgcaagcggctcatcggtcgacatcaaaccccgcagccgcgacgtgaccgacgggctcgagcgcaccgccgcgcgcggcatgctgcgcgcggtcggcatgaccgacgacgactgggtcaagccccagatcggggtcggctcgtcgtggaacgagatcacgccgtgcaacatgtcgctgcagcggctggcccaggcggtcaagggcggtgtgcacgaggccgggggttacccgctggagttcggcacgatctccgtctccgacggcatctcgatgggccacgagggcatgcacttctcgctggtgtcccgcgaggtcatcgccgacagcgtcgagaccgtggtgcaggccgaacgcctcgacggcacggtgttgctggccggctgcgacaagtcgatccccggcatgctgatggccgcggcccgcctcgatctggcgagcgtgttcttctacaacggctcgatcatgccgggcgtcgcgaagctcaccgacggaagcgagaaggaagtcacgatcatcgacgccttcgaggcggtcggtgcgtgtgcgcgcgggctgatgtcgcgggaggacgtcgacatcatcgagcgggccatctgccccggtgagggcgcctgcggtggcatgtacaccgccaacacgatggcctcggccgccgaggcgctcggcatgtcgctgccgggcagcgcgtctccggtggcgatcgacaagcggcgcgacgactttgcgcgccgctccggcgaggcggtggtcgagatgctgcgtcgcggcatcaccgcccgcgacatcctgaccaaggaggccttcgagaacgcgatcgccgtcgtgatggccttcggcggttccaccaacgcggtgctgcatctgctggccatcgcgtgggaggcgcaggtcgagctgacgctggcggacttcacccggatcgggcagaaggtgccgcacctggcggatgtgaagccgttcggcgcgtacgtgatgaagcacgtcgacgagatcggcggcgtgccggtggtgatgcgggcactgctcgacgccggactgctgcacggggactgcctcacggtgaccggtcagacgatggccgagaacctggcccacatcgagccgccggaccccgacggcaaggtgctgcgggcgatgaacaacccgatccacccgaccggcggcatcacgatcctgcacggatcgctggcccccgagggcgcggtggtcaagtcggccggcttcgactccgacgtgttcgagggcaccgcacgggttttcgagcgcgaacgggcggcgctcgacgcgctggaggacggcacgatcacccacggcgacgtcgtcgtcatccgttacgagggccccaagggcggcccggggatgcgcgagatgctggcgatcaccggtgcgatcaagggcgccgggctgggcaaggacgtgctgctgatgaccgacggacggttctcgggcgggacgacgggtctgtgcgtcgggcacatcgcgccggaggccgtcgacggcggaccgatcgcattcgtgcgtgacggggacaggatccggttggacgtcgccaacggcacgctggacatcctcgtcgacgaggccgagttcgaatcgcgcaaggcgggcttcgaaccgctgccgccggtctacacgacgggggtgctcgccaagtacacgaagctggtgggttcggcggcggtcggcgcggtctgcagttag

SEQ ID NO: 4 - protein, 589 aa, Mycobacterium gilvum
MWPMNRRAHNHPMPSDSRSHSLRASGSSVDIKPRSRDVTDGLERTAARGMLRAVGMTDDDWVKPQIGVGSSWNEITPCNMSLQRLAQAVKGGVHEAGGYPLEFGTISVSDGISMGHEGMHFSLVSREVIADSVETVVQAERLDGTVLLAGCDKSIPGMLMAAARLDLASVFFYNGSIMPGVAKLTDGSEKEVTIIDAFEAVGACARGLMSREDVDIIERAICPGEGACGGMYTANTMASAAEALGMSLPGSASPVAIDKRRDDFARRSGEAVVEMLRRGITARDILTKEAFENAIAVVMAFGGSTNAVLHLLAIAWEAQVELTLADFTRIGQKVPHLADVKPFGAYVMKHVDEIGGVPVVMRALLDAGLLHGDCLTVTGQTMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVANGTLDILVDEAEFESRKAGFEPLPPVYTTGVLAKYTKLVGSAAVGAVCS

SEQ ID NO: 5 - DNA, 1716 bp, Mycobacterium smegmatis
atgccctcagacgacaagtccactgagactcctgacatcaagccccgcagtcgcgacgtcaccgacggcctcgagaaggcggccgcccgtgggatgctccgtgcggtaggcatgggcgacgccgactgggccaagccgcagatcggcgtcgggtcgtcgtggaacgagatcacgccgtgcaacatgtcgctgcagcgcctcgcgaagtcggtcaaggacggcgtccacgaggcgggcggctacccgctcgaattcggcaccatctcggtgtccgacggcatctcgatgggccacgagggcatgcacttctcgctggtctcgcgcgaggtgatcgccgacagcgtcgagaccgtcgtgcaggccgagcgcctcgacggcacggtcctgctggccggctgcgacaagtccattccgggcatgctcatggctgccgcgcggctggacctcgcctcggtgttcttctacaacggctcgatcatgccgggtgtcgcgaagctgaccgacggcaccgagaaggaagtcacgatcatcgacgcgttcgaggccgtcggcgcgtgcgtgcgcggcctgatgtcgcgtgaggacgtcgacatcatcgagcgcgcgatctgccccggcgagggtgcctgcggcggcatgtacaccgccaacaccatggccagcgccgccgaggccctcggcctgtcgctgcccggcagcgcgtcgccggtcgccatcgacaagcgccgcgacgagttcgcgcgccgctccggcgaggccgtcgtcgacatgctgcgtcgcggcatcaccgctcgcgacatcctcaccaaggaggccttcgagaacgccatcgccgtggtcatggcgttcggcgggtccaccaacgccgtgctgcacctgctggcgatcgcccgcgaggccgaggtggagctgacgctcgacgatttcacgcgcgtcggcagcaaggtcccgcacctcgcggacgtcaagccgttcggccgccatgtcatgaagcacgtcgacgagatcggcggtgtgcccgtggtgatgcgcgctctgctggatgccggtctgctgaacggcgagtgcctgacggtcacgggcaagaccatggccgagaacctggcccacatcgctcccccggatcccgacggcaaggtgctgcgggccatgaacaacccgatccacccgaccggcggcatcacgatcctgcacggctcgctcgctcccgagggtgcggtggtcaagtcagccggcttcgattcggacgtgttcgagggcactgcaagggttttcgaccgcgaacgtgccgcgatggacgcgctcgaggacggcaccatccaggcgggcgacgtcgtggtgatccgctacgagggccccaagggcggtcccggtatgcgcgagatgctcgcgatcaccggcgccatcaagggtgcgggtctgggcaaggacgtgctgctgatgaccgacggtcggttctcgggcggtacgacgggtctgtgcgtcgggcacatcgcgccggaggccgtcgacggcggcccgatcgcgttcgtgcgcgacggtgaccgcatccgcctcgacgtcgccaagggcacgctcgacgtgctcgtcgacgaagaagagttcgaggcccgcaaggccggcttcgaacccctgccgccgcggtacaagaccggtgtgctggccaagtacaccaagctggtccagtccgccgccgtcggcgcagtctgcacctaa

SEQ ID NO: 6 - protein, 571 aa, Mycobacterium smegmatis
MPSDDKSTETPDIKPRSRDVTDGLEKAAARGMLRAVGMGDADWAKPQIGVGSSWNEITPCNMSLQRLAKSVKDGVHEAGGYPLEFGTISVSDGISMGHEGMHFSLVSREVIADSVETVVQAERLDGTVLLAGCDKSIPGMLMAAARLDLASVFFYNGSIMPGVAKLTDGTEKEVTIIDAFEAVGACVRGLMSREDVDIIERAICPGEGACGGMYTANTMASAAEALGLSLPGSASPVAIDKRRDEFARRSGEAVVDMLRRGITARDILTKEAFENAIAVVMAFGGSTNAVLHLLAIAREAEVELTLDDFTRVGSKVPHLADVKPFGRHVMKHVDEIGGVPVVMRALLDAGLLNGECLTVTGKTMAENLAHIAPPDPDGKVLRAMNNPIHPTGGITILHGSLAPEGAVVKSAGFDSDVFEGTARVFDRERAAMDALEDGTIQAGDVVVIRYEGPKGGPGMREMLAITGAIKGAGLGKDVLLMTDGRFSGGTTGLCVGHIAPEAVDGGPIAFVRDGDRIRLDVAKGTLDVLVDEEEFEARKAGFEPLPPRYKTGVLAKYTKLVQSAAVGAVCT

SEQ ID NO: 7 - DNA, 1698 bp, Mycobacterium vanbaalenii
atgccctcatcgccagacatcaagccccgtagccgcgacgtcaccgacggcctggagaaggccgccgcccggggaatgctgcgcgcggtaggcatgggcgacgaggacttcgccaaaccgcagatcggcgtcggctcgtcctggaacgagatcaccccgtgcaacctgtcgctggaccggctcgccaaggcggtcaaggaaggcgtcttcgaggccggcggcttcccgatggagttcggcaccatctcggtttccgacggcatctcgatgggccatgaaggcatgcacttttcgttggtgtcgcgcgagatcatcgccgacagcgtcgagacggtgatgcaggccgagcgtctggacggctcggtgctgctcgccggatgcgacaagtcgctgcccggcatgctgatggccgctgcgcggctcgacctggccagcgtttttctctacgccggctcgatcctgcccggccgggtcaagctgtccgacggcagcgagaaggacgtcacgatcatcgacgccttcgaggccgtcggcgcctgcgcgcgcgggctgatgccccgcgaggacgtcgacgccatcgagcgtgcgatctgcccgggtgaaggcgcctgcggcggcatgtacaccgccaacacgatggccagcgccgccgaggcgctcggcatgtcgctgcccggctccgccgccccgccggccaccgaccggcgccgcgacggcttcgcccgcaagagcggcatggccgtcgtcgaactgctgcgccgaggcatcaccgcccgcgacatcctgaccaaggaggcgttcgagaacgcgatcgcggtcgtgatggcgttcggcggctccaccaacgcggtgctgcacctgctcgcgatcgcctacgaggccaacgtcaagctgaccctggaggacttcacccgcgtcggcgccaaggtgccgcacctggccgacgtgaaaccgttcggcgcgtacgtgatgaacgacgtcgaccggatcggcggcgttccggtcgtgatgaaggctctgctggacgccggtctgctgcacggggactgcctcaccgtcaccggtaagacgatggccgagaaccttgcccacatcgccccgcccgaccccgacggcaaggtgctgcgcgctctcagcaggccgatccatcccaccggcggcatcacgatcctgcacggctcgctggctcccgaaggtgcggtggtgaagtccgccgggttcgactccgacgtgttcgaaggcaccgcaagggttttcgagcgtgaacgggcagcgctcgacgcgctggaggacggcaccatcacgcacggcgacgtcgtggtcatccgttacgagggccccaagggcggtccgggcatgcgcgaaatgctcgccatcacaggcgcaatcaagggcgccgggctcggcaaggatgtgctgttgatgaccgacggccggttctccggcggcaccaccggtctgtgcgtcggccacatcgccccggaagcggtcgacggcggacccatcgccttcatcaaggacggcgacaagatccgtctcgacgtggccaagggcaccctcgacgttgtggtcgacaaggacgaattcgaggcgcgcaaagtcgggttcgagccgcttccccccgtctacaccaccggggtgctggccaagtacaccaagctcgtcggctcggcggccaccggcgcggtctgcacgtag

SEQ ID NO: 8 - protein, 565 aa, Mycobacterium vanbaalenii
MPSSPDIKPRSRDVTDGLEKAAARGMLRAVGMGDEDFAKPQIGVGSSWNEITPCNLSLDRLAKAVKEGVFEAGGFPMEFGTISVSDGISMGHEGMHFSLVSREIIADSVETVMQAERLDGSVLLAGCDKSLPGMLMAAARLDLASVFLYAGSILPGRVKLSDGSEKDVTIIDAFEAVGACARGLMPREDVDAIERAICPGEGACGGMYTANTMASAAEALGMSLPGSAAPPATDRRRDGFARKSGMAVVELLRRGITARDILTKEAFENAIAVVMAFGGSTNAVLHLLAIAYEANVKLTLEDFTRVGAKVPHLADVKPFGAYVMNDVDRIGGVPVVMKALLDAGLLHGDCLTVTGKTMAENLAHIAPPDPDGKVLRALSRPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFIKDGDKIRLDVAKGTLDVVVDKDEFEARKVGFEPLPPVYTTGVLAKYTKLVGSAATGAVCT

SEQ ID NO: 9 - DNA, 1707 bp, Nocardia farcinica
gtggccgagcagacgaacacccccgacctcaagccccgcagccgcgacgtcaccgacgggctggaacgcaccgccgcccgcggcatgctgcgcgcggtgggcatgggcgacgacgactgggagaagccgcagatcggcgtcgcctcctcctggaacgagatcaccccgtgcaacctgtcgctggaccggctcgcgcagggctgcaaggacggcgtgttcgccgccggtggcttcccgatgcagttcggcaccatctcggtctccgacggcatctcgatgggccacgagggcatgcacttctcgctggtgtcgcgcgaagtgatcgccgacagcgtggagacggtgatgcaggccgagcggctcgacggctcggtgctgctggccgggtgcgacaagtcgctgcccggcatgctgatggccgcggcccgcctcgacctggccagcgtgttcctctacgcgggctcgatcctgcccggcatcgccaagctctccgacggcaccgagcgcgaggtgacgatcatcgacgcgttcgaggcggtcggagcgtgcgcgcgcgggctgatgagccgggccgacgtcgacgccatcgaacgcgcgatctgtcccggcgagggcgcctgcggcggcatgtacaccgccaacacgatggccagcgcggccgaggcgctgggcatgtcgctgcccggcagcgccgcaccgcccgccaccgaccgccgccgcgacgggtacgcccgccgcagcggtcaggccgtggtcgagctgctgcgccgcggcatcaccgcccgcgacatcctcaccaaggaggcgttcgagaacgccatcgcggtggtgatggccttcggcggctcgaccaacgcggtgctgcacttgctcgcgatcgcgcacgaggcgcgggtggagctcaccctcgacgatttcgcgcgggtgggcaggcgggtgccgcacctggccgacgtcaagccgttcggcgcgcatgtgatgaccgatgtcgaccgcatcggcggcgtgccggtgatgatgaagaccctgctcgacgccgggctgctgcacggtgactgcctcaccgtcaccggccgcaccgtcgcggagaacctcgcccacatcgccccgcccgacccggacggcaaggtggtgcgcgcgctgaacgatccgatccatcccaccggcggcatcaccatcctgtccggctcgctggcgcccggcggggcggtggtgaaatccgccggtttcgacgaggacgtcttcaccggcacggccagggtcttcgatcgcgaacgcgccgcgatggacgcgctcgaggacggcaccatcaccgcaggcgacgtggtggtcatccgctacgagggccccaagggcggacccggcatgcgcgagatgctggccatcaccgccgccatcaagggcgcgggcctgggcaaggacgtgctgctgctcaccgacggccgcttctccggtggcaccaccggactgtgtgtcgggcacgtcgcgcccgaggcggtggacggtggtccgatcgcgttcgtccgcgacggcgaccgcatccggctcgacgtggccgcgggcaccctggacctgctggtggagcccgccgaactcgagcggcgcaaacaggactggcgaccgctgccgccgcgctacacccgcggcgtgctcgccaagtacaccaagctggtcggttcggcctcggtcggcgcggtctgcgactga

SEQ ID NO: 10 - protein, 568 aa, Nocardia farcinica
MAEQTNTPDLKPRSRDVTDGLERTAARGMLRAVGMGDDDWEKPQIGVASSWNEITPCNLSLDRLAQGCKDGVFAAGGFPMQFGTISVSDGISMGHEGMHFSLVSREVIADSVETVMQAERLDGSVLLAGCDKSLPGMLMAAARLDLASVFLYAGSILPGIAKLSDGTEREVTIIDAFEAVGACARGLMSRADVDAIERAICPGEGACGGMYTANTMASAAEALGMSLPGSAAPPATDRRRDGYARRSGQAVVELLRRGITARDILTKEAFENAIAVVMAFGGSTNAVLHLLAIAHEARVELTLDDFARVGRRVPHLADVKPFGAHVMTDVDRIGGVPVMMKTLLDAGLLHGDCLTVTGRTVAENLAHIAPPDPDGKVVRALNDPIHPTGGITILSGSLAPGGAVVKSAGFDEDVFTGTARVFDRERAAMDALEDGTITAGDVVVIRYEGPKGGPGMREMLAITAAIKGAGLGKDVLLLTDGRFSGGTTGLCVGHVAPEAVDGGPIAFVRDGDRIRLDVAAGTLDLLVEPAELERRKQDWRPLPPRYTRGVLAKYTKLVGSASVGAVCD

SEQ ID NO: 11 - DNA, 1695 bp, Rhodococcus sp.
atgagtaccccggatcccaaaccccgcagccgtgacgtcaccgacggattggagaagaccgcagcgcgcggaatgctccgtgcggtgggcatgggcgacgacgactgggggaaatcccagatcggcgtggcgtcgtcctggaacgagatcaccccctgcaacctgtcgctcgaccggctcgcgaaggccgtcaaggacggcgtccacgccgcaggcgggtatcccctcgagttcggcaccatctccgtgtccgacggcatctcgatgggacacgagggcatgcacttctccctcgtctcccgtgaggtgatcgccgacagcgtggaaacggtgatgcaggccgaacgcctcgacgggtcggtgctcctcgccggttgcgacaagtccctgcccggcatgctgatggccgcggcccgcctcgacctcgcgagcgtgttcctctacgccggttcgatcctgcccggtgtcgcaaaaatgtccgacggcaccgaacgcgacgtcaccatcatcgacgcgttcgaggcggtcggcgcctgttcgcgcggactgatgagccgtgaggacgtcgacgccatcgagcgtgccatctgtcccggcgagggcgcgtgcggcggaatgtacaccgcgaacacgatggccagtgccgccgaggcgctcggcatgtcgctgcccggcagcgcctccccgcccgccaccgaccgtcgtcgcgacggattcgcgaggcgcagcggtgaagccgtcgtcgaactgctccgccgcggcatcaccgccagggacatcctcaccaaggaagcgttcgagaacgccatcgccgtggtcatggccttcggcggttccaccaacgccgtcctgcacctgctggcgatcgcgagcgaagcggatgtggaactgaccctcgacgacttctcccgcgtcggcgcccgcgtcccgcacctcgcggacgtcaaaccgttcggcaagcacgtgatgaaggacgtcgaccacatcggcggcgtccccgtcatcatgaaggccctgctcgacgccgggatgctgcacggcgactgcctcaccgtcaccggcaagaccatggccgagaacctgtcggccatcgcccctcccgacccggacggcaaggtgctccgcgcgatgagttcgcccatccacccgaccggcggaatcacgatcctcaaggggtccctcgccccgggcggcgcggtggtgaagtcggccgggttcgactccgacgtcttcaccggcaccgcccgcgtcttcgaacgggaacgcgccgcgatggatgccctcgaggacggcaccatcacgaacggcgacgtcgtggtcatccgctacgagggccccaagggcggtcccggcatgcgcgagatgctcgcgatcaccggcgcgatcaagggcgccgggctgggcaaggacgtcctcctgctcaccgacggccgattctccggcggcaccaccggcctgtgcgtcggccacgtggcaccggaagccgtcgacggcggtcccatcgcgttcgtccgcgacggcgaccagatccgactggacgtcggaacgggcaccctcgaactgctcgtcgacgaagaggaactcgccggccgcaagaacgggtgggagcctctgcccccgcgctacacccgcggggtcctggccaagtacacgaagctcgtcggttccgcctcgggcggcgccgtctgcgggtag

SEQ ID NO: 12 - protein, 564 aa, Rhodococcus sp.
MSTPDPKPRSRDVTDGLEKTAARGMLRAVGMGDDDWGKSQIGVASSWNEITPCNLSLDRLAKAVKDGVHAAGGYPLEFGTISVSDGISMGHEGMHFSLVSREVIADSVETVMQAERLDGSVLLAGCDKSLPGMLMAAARLDLASVFLYAGSILPGVAKMSDGTERDVTIIDAFEAVGACSRGLMSREDVDAIERAICPGEGACGGMYTANTMASAAEALGMSLPGSASPPATDRRRDGFARRSGEAVVELLRRGITARDILTKEAFENAIAVVMAFGGSTNAVLHLLAIASEADVELTLDDFSRVGARVPHLADVKPFGKHVMKDVDHIGGVPVIMKALLDAGMLHGDCLTVTGKTMAENLSAIAPPDPDGKVLRAMSSPIHPTGGITILKGSLAPGGAVVKSAGFDSDVFTGTARVFERERAAMDALEDGTITNGDVVVIRYEGPKGGPGMREMLAITGAIKGAGLGKDVLLLTDGRFSGGTTGLCVGHVAPEAVDGGPIAFVRDGDQIRLDVGTGTLELLVDEEELAGRKNGWEPLPPRYTRGVLAKYTKLVGSASGGAVCG

SEQ ID NO: 13 - DNA, 1695 bp, Mycobacterium ulcerans
atgccagaagccgatatcaagccccgtagccgcgacgtcactgacggactggaaaaagccgctgcccgtggcatgttgcgggcggtaggcatggtcgacgaagacttcgccaaggcacagatcggggttgcctcgtcctggaacgagattacgccgtgcaacctctcgctggaccggctggccaagtcggtgaaagagggggtgttcgccgcgggcggctacccgcttgagttcggcacgatttcggtctccgacggcatttcgatgggtcacgagggcatgcacttctccctggtgtcgcgcgaagtgatcgccgacagcgtggaaaccgtgatgcaggccgagcgcctcgacggctcggtgctgctggccggatgcgacaaatccctgcccggaatgctgatggccgccgcccgtttggatttggcgtcggtgtttctctacgcgggctcgatccttccgggggtcgccaagctctccgacggcagcgaacgcgaggtcaccatcatcgacgcgttcgaagcggtcggcgcgtgctcgcgagggttgatgagccgagccgacgtcgacgccatcgagcgcgcgatctgccccggcgagggtgcctgtggcgggatgtacacggccaacacgatggccagtgccgctgaagcacttggcatgtcgctgccgggcagcgcggcgcccccggccaccgaccgccgccgcgacgggttcgcccggcaaagcggtcaagccgtcatcgaattgctgcgccagggcattaccgctcgcgacatcatgacccgggaggcgttcgagaacgccatcgcggtggtgatggcattcggcggctcgaccaatgcggtgctgcacctgctggcgatcgcccatgaggccaacgtcgagctcacgctcgacgacttcagccggatcggctcgaaggtgccgcacctagccgatgtcaagccgttcggccgccatgtgatgtcccacgtcgaccacatcggcggtgtgccggtggtcatgaagactttgctggatgccggcctgctgcacggggattgcctgaccgtgaccggccggaccgtggccgagaacctggaggccattgctccgccggacccggacggcaaggtgctacgcgcgctgatcaacccgatccatgcgaccgggggcatcaccatcctgcgtggatccctggcccccgaaggtgccgtggtcaagacggccggcttggacaccgatgtattcgaaggaacggcacgggttttcgacggcgagcgggccgcgctggatgccctcgaggacggcaccatcacccacggtgacgtggtggtgatccgttacgagggacccaagggcggccccgggatgcgggagatgctcgccatcaccggcgcgatcaagggcgccgggctcggcaaagacgtgctgctgttgaccgacggtcgattctccggcggcacaacgggcttctgtgtgggacacatcgcacccgaggcggtggatgccggaccgatcgcgttcgtgcgcgacggcgaccggatccggctcgacgttgccggccggacgctcgacgttctgaccgacccgccagagttcgcggcccgtcaacagaatttcactcctccggcgccgcgttacaagaccggcgtactggccaagtacgtcaagctggtcggctccgccgcgatcggcgcggtctgcggctaa

SEQ ID NO: 14 - protein, 564 aa, Mycobacterium ulcerans
MPEADIKPRSRDVTDGLEKAAARGMLRAVGMVDEDFAKAQIGVASSWNEITPCNLSLDRLAKSVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACSRGLMSRADVDAIERAICPGEGACGGMYTANTMASAAEALGMSLPGSAAPPATDRRRDGFARQSGQAVIELLRQGITARDIMTREAFENAIAVVMAFGGSTNAVLHLLAIAHEANVELTLDDFSRIGSKVPHLADVKPFGRHVMSHVDHIGGVPVVMKTLLDAGLLHGDCLTVTGRTVAENLEAIAPPDPDGKVLRALINPIHATGGITILRGSLAPEGAVVKTAGLDTDVFEGTARVFDGERAALDALEDGTITHGDVVVIRYEGPKGGPGMREMLAITGAIKGAGLGKDVLLLTDGRFSGGTTGFCVGHIAPEAVDAGPIAFVRDGDRIRLDVAGRTLDVLTDPPEFAARQQNFTPPAPRYKTGVLAKYVKLVGSAAIGAVCG

SEQ ID NO: 15 - DNA, 1728 bp, Mycobacterium avium
atgcccaccaccgattcggcgcgcgccgccgacatcaagcagcccgacatcaagccgcgcagtcgtgacgtcaccgacggcctggagaaggccgccgcccgggggatgctgcgggcggtaggcatgggcgacgaggacttcgccaagccgcagatcggggtggcgtcgtcctggaacgagatcacgccgtgcaacctgtcgctggaccggctggccaaggcggtcaaggaaggcgtcttcgccgcgggcggctacccgctggagttcggcaccatctcggtgtccgacggcatctcgatgggccacgagggcatgcacttctcgctggtgagccgcgaggtgatcgccgacagcgtcgagacggtgatgcaggccgagcgcctggacggctcggtgctgctggccggctgcgacaagtcgctgcccggcatgctgatggccgcggcccgcctggacctggcctcggtgttcctctacgccggctcgatcctgcccggggtggccaagctgtccgacggcagcgagcgcgaggtgacgatcatcgacgcgttcgaggccgtcggcgcgtgcgcgcgcgggctgatgccgcgcgaggacgtcgacgccatcgagcgggccatctgtcccggcgagggcgcctgcggcggcatgtacacggccaacaccatggccagcgccgccgaggcgctggggatgtcgctgccgggcagcgcggccccgccggccaccgaccgccgccgcgacggcttcgcccggcgcagcggccaggccgtcgtcgagctgctgcgccgcggcatcaccgcccgcgacatcctcaccaaggaggcgttcgagaacgcgatcgcggtggtgatggcgttcggcggctccaccaacgcggtgctgcacctgctggccatcgcccacgaggccgacgtggcgctgtcgctcgacgacttcagccggatcgggtcgaaggtgccgcacctggccgacgtcaagccgttcggccggcacgtgatgaccgacgtcgaccacatcggcggcgtgccggtgatgatgaaggcgctgctggacgccgggctgctgaacggcgactgcctgacggtgaccggtgcgacggtggcgcagaacctggccgcgatcgccccgcccgacccggacggcaaggtgctgcgggcactcagcgatccgttgcacccgaccggcggcatcaccatcctgcgcgggtcgctggcgcccgagggcgcggtggtcaagtccgccggcttcgattccgacgtgttcgaaggcaccgcaagggttttcgacggcgagcgggccgcgctggacgcgctggaggacggcaccatcaccaagggcgacgcggtggtgatccggtacgagggccccaagggcgggcccgggatgcgcgagatgctcgccatcaccggcgcgatcaagggcgccgggctgggtaaggacgtgctgttactcaccgacggccgcttctccggcgggacgacgggactgtgtgtcggccacatcgcgcccgaggcggtggacgcagggccgatcgcctttctgcgcgacggcgaccgcatccgcctggacgtcgccaaccgggttctggacgtactcgtcgatccggccgaattcgactctcggcgaacaggtttcaccccgccgccgccccgctacaagaccggggtgctggccaagtacgtcaagctcgtcggttccgcggcgatcggcgccgtctgcggctag

SEQ ID NO: 16 - protein, 575 aa, Mycobacterium avium
MPTTDSARAADIKQPDIKPRSRDVTDGLEKAAARGMLRAVGMGDEDFAKPQIGVASSWNEITPCNLSLDRLAKAVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACARGLMPREDVDAIERAICPGEGACGGMYTANTMASAAEALGMSLPGSAAPPATDRRRDGFARRSGQAVVELLRRGITARDILTKEAFENAIAVVMAFGGSTNAVLHLLAIAHEADVALSLDDFSRIGSKVPHLADVKPFGRHVMTDVDHIGGVPVMMKALLDAGLLNGDCLTVTGATVAQNLAAIAPPDPDGKVLRALSDPLHPTGGITILRGSLAPEGAVVKSAGFDSDVFEGTARVFDGERAALDALEDGTITKGDAVVIRYEGPKGGPGMREMLAITGAIKGAGLGKDVLLLTDGRFSGGTTGLCVGHIAPEAVDAGPIAFLRDGDRIRLDVANRVLDVLVDPAEFDSRRTGFTPPPPRYKTGVLAKYVKLVGSAAIGAVCG

SEQ ID NO: 17 - DNA, 1728 bp, Mycobacterium tuberculosis
atgccgcaaaccaccgacgaagccgcttccgtctcgacggtcgccgacatcaagccccgcagtcgagacgtcaccgacggcctggagaaggccgctgcccggggcatgttgagggcggtgggcatggacgacgaagacttcgcgaagccacagatcggggtcgcgtcgtcgtggaacgaaatcacgccgtgcaatctctcattggaccggctggccaacgcggtcaaggagggggtgttttcggccggcggctatccgcttgagttcggcacgatctcggtttcggacggcatctccatgggtcatgaggggatgcacttctcgctggtttcccgtgaggtgatcgccgacagcgtcgaagtcgtgatgcaggccgaacgactcgacggttcggtgctgctggccggatgcgacaaatcgctgcccggaatgctgatggccgccgcacgactggatctggcggcggtgttcctctacgcgggctctattttgcccggccgggccaagctctccgacggtagcgaacgagacgtcaccatcattgacgccttcgaggcggtcggagcgtgctctcgcggtttgatgagtcgcgccgacgtcgatgccatcgagcgggcaatctgccccggcgaaggggcatgcggcggcatgtacaccgctaacaccatggccagcgccgccgaggcgctcggcatgtcgttgccgggcagcgcggcaccgccggcgaccgaccgccggcgcgacgggttcgcgcgtcgcagcgggcaggccgtcgtcgagctgctgcgccgcggcatcaccgcccgcgacatcctcaccaaggaggcgttcgagaacgccatcgcggtgggaatggcgttcggcggctcgaccaacgcggtgctgcatctgctggccatcgcccacgaggccaacgtcgcactatcgcttcaggacttcagccggatcgggtcgggggtgccgcatttggccgatgtcaagccgttcggccgccatgtgatgtccgacgtcgatcacatcggcggtgtgccggtggttatgaaggcgctgctggacgccggtctgctacacggcgactgcctgacggttaccggtcacaccatggccgagaatctggctgccatcaccccgccggatccagatggcaaggtgctacgtgcgttggcaaacccgatccacccgagcggtggcatcaccatcctgcacggatcgctggcacccgaaggtgcggtggtcaagaccgccggattcgattccgacgtattcgaaggcaccgcaagagttttcgacggcgagcgcgctgcgctggacgcccttgaggatggcaccattaccgtgggcgacgccgtggtaatccggtacgaaggacccaagggcggccccgggatgcgcgaaatgctcgccatcacaggcgcgatcaaaggcgcaggactcggtaaagatgttctactgctgaccgacggccggttctccggtggaaccaccggcctgtgcgttggccacatcgcaccggaggcggtcgacggcggaccgatcgcacttctgcgcaacggcgaccggatccggctcgacgtggccggccgcgttctcgatgtgttggccgatccggccgaattcgcgtcccgacaacaggatttcagtcctccaccgccgcgctacactactggcgtactgtccaagtacgtcaagctggtcagctctgccgcggtcggcgcggtctgcggctag

SEQ ID NO: 18 - protein, 575 aa, Mycobacterium tuberculosis
MPQTTDEAASVSTVADIKPRSRDVTDGLEKAAARGMLRAVGMDDEDFAKPQIGVASSWNEITPCNLSLDRLANAVKEGVFSAGGYPLEFGTISVSDGISMGHEGMHFSLVSREVIADSVEVVMQAERLDGSVLLAGCDKSLPGMLMAAARLDLAAVFLYAGSILPGRAKLSDGSERDVTIIDAFEAVGACSRGLMSRADVDAIERAICPGEGACGGMYTANTMASAAEALGMSLPGSAAPPATDRRRDGFARRSGQAVVELLRRGITARDILTKEAFENAIAVGMAFGGSTNAVLHLLAIAHEANVALSLQDFSRIGSGVPHLADVKPFGRHVMSDVDHIGGVPVVMKALLDAGLLHGDCLTVTGHTMAENLAAITPPDPDGKVLRALANPIHPSGGITILHGSLAPEGAVVKTAGFDSDVFEGTARVFDGERAALDALEDGTITVGDAVVIRYEGPKGGPGMREMLAITGAIKGAGLGKDVLLLTDGRFSGGTTGLCVGHIAPEAVDGGPIALLRNGDRIRLDVAGRVLDVLADPAEFASRQQDFSPPPPRYTTGVLSKYVKLVSSAAVGAVCG

SEQ ID NO: 19 - DNA, 1695 bp, Mycobacterium lepraea
atgatgccccctgacatcaaaccccgcagccgcgacgttaccgatggcctggagaaggccgctgctcgtggcatgttgcgcgcagtcggcatgaacgatgacgacttcgccaaggcgcagatcggagttgcgtcatcatggaacgagatcacaccttgcaatctctcgctggaccgcctggccaaggcggtcaaggagggggtattctcggccggcggttatccgcttgagttcggaacaatttcggtttccgacggcatctcgatggggcaccaggggatgcacttctcgctggtgtcgcgcgaggttatagcggacagcgtcgaaaccgtaatgcaggccgagcgcctcgacggctcagtgcttttggctggctgcgataaatcactacccggaatgctgatggccgccgcacgtctcgacctcgcgtcggtatttctctacgccggctcgatcttgcccggacgaaccaagctctccgacggcaccgaacacgaagtcacgctcatcgacgcattcgaagcggtcggcgcgtgttctcgcggattaatgccccgcgctgatgtcgacgccatcgagcgggcgatctgccccggcgagggggcatgcggtggcatgtacactgccaacactatggccagcgcagcagaggcgctgggtatgtccttgccgggcagcgctgcgccgccggcaacagaccgtcgccgtgatggcttcgcgcggcgtagcgggcaggccgtcatcgaactgctgcgtcgcggtataaccgctcgcgacatccttaccaaggaagcgtttgagaacgcgatcgcggtggtgatggcgttcggtggctcgaccaacgcgatcctgcatctactggccattgcccatgaggccgacgtcaccttgtcgctcgaggacttcagtcggatcggatttaaggtgccgcatatagccgacgttaagccgttcggccggcacgtgatgttcgacgtcgaccacatcggtggtgtgccggtggtaatgaaagcacttctggacgcaggtctactgcacggtgattgcctgacggtgaccggtcagacgatggccgagaacctagcctccattgccccgccagacccggatggccaggtgatccgcacgttgcataatccaattcatccgacgggaggcattacgatcctgcgtggatcgttggcacctgatggcgcggtggttaagacggctggactcgactccgatgtgttcgaaggaactgcaagggttttcgacggagaacgggccgcgttggacgcactcaaggacggcaccatcgccaaaggcgatgttgtggttatccgctatgaaggcccgaaaggcggcccggggatgcgcgaaatgctagccatcaccggtgccatcaaaggtgccgggctaggcaaagatgttctgctacttactgacggcaggttctctggcggaacgaccggcttttgcgtaggacacatcgcgccggaagctgtcgaagcgggaccaatcgcattcctgcgtgacggcgaccgggtcctgctagacgttgtcggctgctccctcgatgtgctggtcgatccagtcgaattttcctctcggaaaaaggatttcattcctcctgcgccacgctacaccaccggtgtgcttgccaagtacgtcaagctcgtcagttcggcgacggtcggcgcggtctgcggttag

SEQ ID NO: 20 - protein, 564 aa, Mycobacterium lepraea
MMPPDIKPRSRDVTDGLEKAAARGMLRAVGMNDDDFAKAQIGVASSWNEITPCNLSLDRLAKAVKEGVFSAGGYPLEFGTISVSDGISMGHQGMHFSLVSREVIADSVETVMQAERLDGSVLLAGCDKSLPGMLMAAARLDLASVFLYAGSILPGRTKLSDGTEHEVTLIDAFEAVGACSRGLMPRADVDAIERAICPGEGACGGMYTANTMASAAEALGMSLPGSAAPPATDRRRDGFARRSGQAVIELLRRGITARDILTKEAFENAIAVVMAFGGSTNAILHLLAIAHEADVTLSLEDFSRIGFKVPHIADVKPFGRHVMFDVDHIGGVPVVMKALLDAGLLHGDCLTVTGQTMAENLASIAPPDPDGQVIRTLHNPIHPTGGITILRGSLAPDGAVVKTAGLDSDVFEGTARVFDGERAALDALKDGTIAKGDVVVIRYEGPKGGPGMREMLAITGAIKGAGLGKDVLLLTDGRFSGGTTGFCVGHIAPEAVEAGPIAFLRDGDRVLLDVVGCSLDVLVDPVEFSSRKKDFIPPAPRYTTGVLAKYVKLVSSATVGAVCG

SEQ ID NO: 21 - DNA, 1692 bp, Kineococcus radiotolerans
gtgagcgtcgacatcaagccccgcagtcgccaggtcaccgacggtctggaggcgaccgcctcgcgcggcatgctccgcgccgtcggcatgggcgacgacgactgggagaagccccagatcggggtggcctccagctggaacgagatcaccccctgcaacctgtccctggaccgcctcgcgaaggccgtcaaggacggcgtgcactccgcccacggcttcccgatggagttcggcaccatctccgtctccgacggcatctcgatgggccacgaggggatgcactactccctcgtctcgcgcgaggtcatcgccgactccgtcgagaccgtcatgagcgccgagcgcctcgacgggtccgtcctgctcgccggctgcgacaagtccctgccggggatgctcatggccgccgcgcgcctggacctggccagcgtcttcctctacgccggcacgatcctgcccgggcgggccaagctgtccgacggcagcgagcacgaggtcaccctcatcgacgccttcgaggccgtcggggcgtgcgcgcgggggctgatgtcccgcgaggacgtcgacgtcatcgagcgcgccatctgccccggcgagggggcctgcgggggcatgtacaccgcgaacacgatggccgccgcggccgaggcgctggggatgtccctgcccggcagcgcggccccgcccgcgaccgaccgccgtcgcgacgggttcgcccgccgctccggcgaggccgtggtgaacctgctctcgaagggcatcaccgcccggcagatcctcaccaaggaggcgttcgagaacgccatcgccgtcgtcatggccctgggcggctccaccaacgccgtcctgcacctgctggccatcgcctacgaggccgaggtcgacctcaccctcgccgacttcgaccgcgtcgccgcgaaggtcccgcacctggccgacctcaagcccttcggccgccacgtcatggtcgacgtcgaccgcatcggcggcatccccgtcgtcatgcgcgcgctgctggacgcgggcctgctgcacggggactgcctgacggtgaccgggaggacgatggccgagaacctcgccgacatcgccccgcccgacgtcgacggcgtcgtgctgcgctcgctgcaggaccccatccacaagaccggcggcatcacgatcctctccggcaacctcgcccccggcggcgcggtggtgaagagcgcgggcttcgactccgacgtcttcgagggcaccgcgcgggtcttcgagcgcgagcgcgccgccctggacgccctggaggacggcacgatctccgccggcgacgtcgtcgtcatccgctacgagggccccaagggcggcccggggatgcgcgagatgctcgccatcaccggcgcgatcaagggcgcgggcctgggcaaggacgtgctgctcatgaccgacgggcgcttctccggcgggacgacgggcctgtgcgtggggcacgtggcccccgaggccgtcgacgccggtcccatcgcgttcgtgcgcgacggggaccggatccgcctggacgtcgccggcaagaccctcgaggtgctggtggacgaggaggagctcgccgcccgccgcgagggctgggagccgctgcccccggtcttcaagcgcggggtgctggccaagtacgccaagcaggtccagtccgcctcgctcggggccgtctgccgctga

SEQ ID NO: 22 - protein, 563 aa, Kineococcus radiotolerans
MSVDIKPRSRQVTDGLEATASRGMLRAVGMGDDDWEKPQIGVASSWNEITPCNLSLDRLAKAVKDGVHSAHGFPMEFGTISVSDGISMGHEGMHYSLVSREVIADSVETVMSAERLDGSVLLAGCDKSLPGMLMAAARLDLASVFLYAGTILPGRAKLSDGSEHEVTLIDAFEAVGACARGLMSREDVDVIERAICPGEGACGGMYTANTMAAAAEALGMSLPGSAAPPATDRRRDGFARRSGEAVVNLLSKGITARQILTKEAFENAIAVVMALGGSTNAVLHLLAIAYEAEVDLTLADFDRVAAKVPHLADLKPFGRHVMVDVDRIGGIPVVMRALLDAGLLHGDCLTVTGRTMAENLADIAPPDVDGVVLRSLQDPIHKTGGITILSGNLAPGGAVVKSAGFDSDVFEGTARVFERERAALDALEDGTISAGDVVVIRYEGPKGGPGMREMLAITGAIKGAGLGKDVLLMTDGRFSGGTTGLCVGHVAPEAVDAGPIAFVRDGDRIRLDVAGKTLEVLVDEEELAARREGWEPLPPVFKRGVLAKYAKQVQSASLGAVCR

SEQ ID NO: 23 - DNA, 1704 bp, Janibacter sp.
atgagcaagcccgacatcgacatcaagccccgtagccgcgacgtcaccgacggtctcgagaagaccgcggcccgaggaatgctccgtgccgtaggcatgggcgacgacgactgggtcaagccacagatcggtgtcgcgagctcctggaacgagatcaccccctgcaacctctctctcgaccgcctgtccaaggcagtcaaggacggcgtccacgctgccggtggctacccgctcgagttcggcacgatctcggtgtccgacggcatctcgatgggccacgagggcatgcacttctcgctcgtgtcgcgcgagatcatcgccgactccgtcgagaccgtcatgagtgccgagcgcctcgacggctcggtcctgctcgccggctgcgacaagtccctcccgggcatgctcatggctgcggcgcgcctcgacctcgcctcggtcttcctgtatgccgggtcgatccttcccgggatcgcgaagctctcggacggcaccgagaaggaggtcacgatcatcgacgccttcgaggccgtcggtgcagccaacgcgggcaagatgtcgctggccgacgtcgacgccatcgagcgcgcgatctgtccgggggagggcgcctgtggcggtttctacacggccaacaccatggctgcggtcgccgagtcgatcggcatgtccatcccgggttcggccgccccgccagccaccgaccgacgccgcgacgtgcacgcccgccgctccggtgaggccgtcgtcgagctcctgcgtcgcggcatcaccgcccgccagatcatgaccaagcccgcgttcgagaacgccatcgccgtcgtcatggccttcggtggctcgaccaacgccgtcctccacctgctcgccatggcccacgaggccgaggtcgacctcaccatcggcgacttccagcgcatcggcaaaaaggtcccgcacctcgccgacgtcaagccgttcggcgccttcgtcatgaaggacatcgaccacatcggtggcatccccgtcgtcatgaagtcgctgctcgaggccgacctcctcgatggcgacgcactcaccgtgaccggcaagaccgtcgccgagaacctcgacgagatcaagccgccgcacatcgacggtcgcgtgatccgcgagttcagcaacccgatccacaagaccgggggcctcaccatcctcaccggctccctcgcgcccgaaggtgcggtcgtgaagtcggccggattcgacaccgaggtcttcgagggcagcgcccgcgtcttcaacggcgagcgtgccgcgatggatgccgtcgagcagggtgccctcaagccccaggacgtcgtcgtcatccgctacgaagggcccaagggtggcccgggaatgcgcgagatgctcgccgtcaccggcgccatcaagggcgcgggtctcggcaaggacgtcctcctcctcaccgacggtcgcttctccggtggcacgaccggcctctgcgtcggacacgtggcccccgaggccgtcgacgagggccccatcgccttcgtccgtgacggagacggcatccgcctcgacgtcgcgaacggcactcttgacctcctcgtcgacgacgccgagctcgagcgccgccgcaccgagggcgtcacccatcccgagcccaagtacacccgcggcgtgctcgcgaagtaccgcaagctcgtcggctcggccagcaagggcgccgtctgcgactga

SEQ ID NO: 24 - protein, 567 aa, Janibacter sp.
MSKPDIDIKPRSRDVTDGLEKTAARGMLRAVGMGDDDWVKPQIGVASSWNEITPCNLSLDRLSKAVKDGVHAAGGYPLEFGTISVSDGISMGHEGMHFSLVSREIIADSVETVMSAERLDGSVLLAGCDKSLPGMLMAAARLDLASVFLYAGSILPGIAKLSDGTEKEVTIIDAFEAVGAANAGKMSLADVDAIERAICPGEGACGGFYTANTMAAVAESIGMSIPGSAAPPATDRRRDVHARRSGEAVVELLRRGITARQIMTKPAFENAIAVVMAFGGSTNAVLHLLAMAHEAEVDLTIGDFQRIGKKVPHLADVKPFGAFVMKDIDHIGGIPVVMKSLLEADLLDGDALTVTGKTVAENLDEIKPPHIDGRVIREFSNPIHKTGGLTILTGSLAPEGAVVKSAGFDTEVFEGSARVFNGERAAMDAVEQGALKPQDVVVIRYEGPKGGPGMREMLAVTGAIKGAGLGKDVLLLTDGRFSGGTTGLCVGHVAPEAVDEGPIAFVRDGDGIRLDVANGTLDLLVDDAELERRRTEGVTHPEPKYTRGVLAKYRKLVGSASKGAVCD

SEQ ID NO: 25 - DNA, 1704 bp, Nocardioides sp.
atgaccgagcccacctcccgccccgacatcaagccccgctcccgcgacgtcaccgacggcctggagaaggccgccgcgcgcggcatgctgcgggcggtaggcatgggcgacgaggacttcgcgaagccgcagatcggcgtgggctcgagctggaacgagatcaccccgtgcaacctgtccctggaccggctcgccaaggccgtgaagaacggcgtgcacgcggccggcggctacccgctggagttcggcaccatctcggtctccgacggcatctccatgggccacgagggcatgcacttctcgctggtctcccgcgaggtgatcgccgactcggtcgagaccgtgatgatggccgagcgcctggacggctcggtgctgctcgccggctgcgacaagtcgctgccgggcatgatgatggccgccgcccgcctcgacctggccagcgtgttcctctacgccggctcgacgatgcccgggcaggtggacggcaacgacgtcacgatcatcgacgcgttcgaggccgtcggggcgtgcctggccggcaagatcagccgcgacgaggtggaccggatcgagcgggccatctgtccgggcgagggcgcctgcggcggcatgtacaccgcgaacacgatggcctccatcgccgaggcgatcggcatgtcgctccccggctcggcggccccgccggcggtcgatcgccgacgcgacggcttcgcgcaccgctcgggggaggccgtggtcaacctgttgcgccagggcatcacggcccgccagatcatgactcgcgcggcgttcgagaacgcgatcacggtcgcgatggcgctcggcggctcgaccaacgccgtgctccacctgctcgcgatggctcgtgaggccgacgtcgacctcaccatcgacgacttcaaccggatcggtgacaaggtgccgcacctcggcgacctcaaaccgttcggcaagtacgtcatgaacgacgtcgacaagatcggcggcatccccgtcgtgatgaaggcactgctcgacgccggtctgatgcacggcgacgcgctcaccgtcaccggcaagaccctggccgagaacctcgccgagctggccccgccggagctcgatgacgaggtgatccgcaagctggaccggccgatccacaagaccggtgggctcacgatcctcaagggctcgctcgctcccgagggcgccgtggtcaagacggccggcttcgacgactccgtgttcaccggcaccgcccgcgtcttcgacggcgagcgggccgcgatggacgccctcgaggccgggcagatccagccccgcgacgtcgtggtgatccgctacgagggcccgaagggtggccccggcatgcgcgagatgctcgcgatcaccggcgcgatcaagggcgccggcctcggcaaggacgtcttgctgatcaccgacggcaggttctccggtggtacgacgggcctgtgcgtgggccacatcgcccccgaggccgtcgacggcggcccgatcgcgttcgtccgcgacggcgaccagatcaccctcgacgtcgccaaccggctgctcgaggtggaggtcgtcggtcccgatgccgaggccgagtgggagcgccgcaaggtcggctgggagccgaatccgcccaagtacacccgcggggtgctcggcaagtacgccaagatcgtccagtccgccgcgcacggcgccatcaccggctga

SEQ ID NO: 26 - protein, 567 aa, Nocardioides sp.
MTEPTSRPDIKPRSRDVTDGLEKAAARGMLRAVGMGDEDFAKPQIGVGSSWNEITPCNLSLDRLAKAVKNGVHAAGGYPLEFGTISVSDGISMGHEGMHFSLVSREVIADSVETVMMAERLDGSVLLAGCDKSLPGMMMAAARLDLASVFLYAGSTMPGQVDGNDVTIIDAFEAVGACLAGKISRDEVDRIERAICPGEGACGGMYTANTMASIAEAIGMSLPGSAAPPAVDRRRDGFAHRSGEAVVNLLRQGITARQIMTRAAFENAITVAMALGGSTNAVLHLLAMAREADVDLTIDDFNRIGDKVPHLGDLKPFGKYVMNDVDKIGGIPVVMKALLDAGLMHGDALTVTGKTLAENLAELAPPELDDEVIRKLDRPIHKTGGLTILKGSLAPEGAVVKTAGFDDSVFTGTARVFDGERAAMDALEAGQIQPRDVVVIRYEGPKGGPGMREMLAITGAIKGAGLGKDVLLITDGRFSGGTTGLCVGHIAPEAVDGGPIAFVRDGDQITLDVANRLLEVEVVGPDAEAEWERRKVGWEPNPPKYTRGVLGKYAKIVQSAAHGAITG

SEQ ID NO: 27 - DNA, 1722 bp, Renibacterium salmoninarum
atgagtgtggaaaccagtagcgaaaccggcaacaaaccagatatcaaaccgagaagccgcattgtcaccgacggaattgccgccgcgcctgctcgaggaatgctccgagccgttggctttggcgacgaggactttgcgaagccgcagattggcgtcgcgagttcgtggaacgaaattaccccctgcaatctctcccttgatcggctggccaaagccgtcaaagagggcgtgcatgccggcggcggcttcccgatgatctttggcacaatttcggtgtccgatggcatttcgatggggcacgaaggtatgcacttctcgcttgtctcccgcgaagtgattgctgactcggtagagactgttatgcaagcagaacgcatcgatggctcggtgctgcttgctggctgcgataagtcattgccgggcatgttgatggccgcagcccggctcaatgtgtccagtgttttcctctacgccggctcaatcatgcccggctgggtcaagcttgaagacggcacagagaaagacgtcacgcttattgacgcctttgaagctgtcggtgcctgcgcagccggcaaaatgtcggtgggggatctagaccgaatcgaacgggcaatttgtccgggcgaaggtgcctgcggtggtatgtacaccgcgaacactatggcctgtattggcgaggccttgggtatgtccttgcctggctcggctgcgccgccaagtgcggaccgccgtcgcgatatgttcgcgcaccgttctggcgaggctgttgttgagttgctccgccggggcattcgctcgcgcgacatcatgaccaaggaagcctttgagaacgcgattgcggtcacgatggcttttggcggctccacgaacgcagtgctgcacctacttgctattgctcgtgaggccgaggttgatctgcagcttgaggacttcaaccgaattggtgacaagatcccgcacctcggcgacctcaagccttttggccgatacgtgatgaacgacgtcgaccgggtgggcggcgtgccggtgataatgcgcgcgctgctcgatgccgggctactgcatggtgatgccttgaccgtgaccggtaagactctggccgaaaatcttgaagcgatcaatccgccagatctggatggcaagattttgcgtgcgttggataatccaatccacaaaactggtgggttgagtgtgctcaagggctcgcttgcacctggcggcgccgtggttaagaccgccgggttcgacgccgaggttttcgaaggcccggctcgggtttttgaacgcgaacaaggcgcactcgaagcgcttaaggctggcgaaatcaaagcgggcgacgtcgtcgtgatccgctatgaaggccctaaaggtgggccgggtatgcgcgaaatgctcgccatcactggcgcgatcaagggcgctggcctgggcaaagacgtgttgttgttgaccgacggtcggttctccggaggtacaacgggtctgtgcatcgggcacgtggcgccggaagctgtcgacgccgggccaatcgcctttgtgcaagacggcgacctaatccgggttgatatccccaacaagagtttcgatctcttggttgacgaagcagagctggaagctcggaaaatcggttgggagccgttgcctgctcgcttcactaaaggcgtgttggctaagtacgctaagcttgtgcactcggcttccgaaggcgcatactgcggctaa

SEQ ID NO: 28 - protein, 573 aa, Renibacterium salmoninarum
MSVETSSETGNKPDIKPRSRIVTDGIAAAPARGMLRAVGFGDEDFAKPQIGVASSWNEITPCNLSLDRLAKAVKEGVHAGGGFPMIFGTISVSDGISMGHEGMHFSLVSREVIADSVETVMQAERIDGSVLLAGCDKSLPGMLMAAARLNVSSVFLYAGSIMPGWVKLEDGTEKDVTLIDAFEAVGACAAGKMSVGDLDRIERAICPGEGACGGMYTANTMACIGEALGMSLPGSAAPPSADRRRDMFAHRSGEAVVELLRRGIRSRDIMTKEAFENAIAVTMAFGGSTNAVLHLLAIAREAEVDLQLEDFNRIGDKIPHLGDLKPFGRYVMNDVDRVGGVPVIMRALLDAGLLHGDALTVTGKTLAENLEAINPPDLDGKILRALDNPIHKTGGLSVLKGSLAPGGAVVKTAGFDAEVFEGPARVFEREQGALEALKAGEIKAGDVVVIRYEGPKGGPGMREMLAITGAIKGAGLGKDVLLLTDGRFSGGTTGLCIGHVAPEAVDAGPIAFVQDGDLIRVDIPNKSFDLLVDEAELEARKIGWEPLPARFTKGVLAKYAKLVHSASEGAYCG

SEQ ID NO: 29 - DNA, 1767 bp, Arthrobacter aurescens
gtgcaacagcgtcggcagtcgcccggtagacatagactttggaccatgagtgacaccacccagattgcgacagacagcacgccggacattaaaccccgcagccgggtggtgacagacggcattcacgcggcgcctgcccgcggcatgttccgtgcggtgggcatgggcgacgacgactttgccaaaccccaaatcggtgttgccagctcgtggaatgaaattaccccttgcaatctttccctgaatcgcctcgcacaaggcgccaaggaaggcgtccatgccggcggcggcttcccgatgcagttcggcacgatctccgtttcggatggtatttccatgggccacgagggcatgcacttctccctggtctcccgcgaagtcatcgccgactctgtggaaacagtgatgcaggccgagcgcattgacggctcggtgctcctggccggctgtgacaagtcccttccgggcatgctcatggctgctgcccgcttggacctcgcatccgtcttcctctacgccggctccatcatgccgggctgggtcaagctggaggacggctcggagaaggaagtcaccctcattgatgccttcgaggccgtgggtgcctgcgccgccggcaaaatgagcatggaagacctcacaaggatcgaaaaggccatctgtcccggcgaaggcgcctgcggcggtatgtacacggccaacaccatggcgtgcatcggcgaggccttgggcatgtccctcccgggttcagccgccccgccgtcggcagaccgccgtcgtgatgatttcgcacgcaagtccggcgaagccgtagtaaacctgctgcgcctgggcatcacggcccgcgacatcatgaccaaaaaggcgttcgagaatgccattgccgtcaccatggccttcggcggttccaccaacgccgtgctgcacttgctcgcgatcgcccgggaagccgaagtagagctgacgctggacgacttcaatcgcatcggcgacaaaattccgcaccttggggacctcaagcccttcggccgttatgtgatgaccgacgttgacaagatcggcggcgtgccggtcatcatgaaggcactgctcgacgccggactactgcacggcgactgcctcaccgttaccggcaagacgctcgcggaaaacctcgcctcgatcaacccgccggaccttgacggcaaaatcctccgtgcgctggacaacccgatccacaagaccggtggcatcaccatcctccacggctctatggctccggaaggagcggtagtgaagagtgccggttttgatgctgacgtctttgaaggaactgcacgcgttttcgaacgcgagcagggcgccctcagcgcgttggacaacggcgaaatcaacaagggagacgtagtggtcatccgctatgaaggccccaagggcggtcccggcatgcgggaaatgttggccatcaccggcgccatcaagggagcgggactcggcaaggatgtcctccttctcacggatggccggttctcgggtggcacaacgggtctgtgcatcggccacgttgcgcctgaagccgtggatggtggccccatcgcgttcgtgaaggacggtgaccgcatccgtgtagacatcgccgctcgctccttcgacctcctggtggacgaagccgagctcgaagcccgcaaagagggctggaagccactgcccgccaagttcaccaagggtgttcttgccaagtacgccaagcttgtccacagcgcctccaccggagcgtactgcggataa

SEQ ID NO: 30 - protein, 588 aa, Arthrobacter aurescens
MQQRRQSPGRHRLWTMSDTTQIATDSTPDIKPRSRVVTDGIHAAPARGMFRAVGMGDDDFAKPQIGVASSWNEITPCNLSLNRLAQGAKEGVHAGGGFPMQFGTISVSDGISMGHEGMHFSLVSREVIADSVETVMQAERIDGSVLLAGCDKSLPGMLMAAARLDLASVFLYAGSIMPGWVKLEDGSEKEVTLIDAFEAVGACAAGKMSMEDLTRIEKAICPGEGACGGMYTANTMACIGEALGMSLPGSAAPPSADRRRDDFARKSGEAVVNLLRLGITARDIMTKKAFENAIAVTMAFGGSTNAVLHLLAIAREAEVELTLDDFNRIGDKIPHLGDLKPFGRYVMTDVDKIGGVPVIMKALLDAGLLHGDCLTVTGKTLAENLASINPPDLDGKILRALDNPIHKTGGITILHGSMAPEGAVVKSAGFDADVFEGTARVFEREQGALSALDNGEINKGDVVVIRYEGPKGGPGMREMLAITGAIKGAGLGKDVLLLTDGRFSGGTTGLCIGHVAPEAVDGGPIAFVKDGDRIRVDIAARSFDLLVDEAELEARKEGWKPLPAKFTKGVLAKYAKLVHSASTGAYCG

SEQ ID NO: 31 - DNA, 1695 bp, Leifsonia xyli
atgcctcagatcgattggaaaccgcgttcgcgcgttgtcacggacgggatcgaagccaccacgagccgcgggatgctccgtgcggtcggcatgggggacgccgactgggagaagccgcagatcggcatcgcctcgtcctggaacgagatcacgccgtgcaacctctcgctcgaccggctggcccagggcgccaaagaaggcgtccactccggtggcggttatccgctgcaattcggtaccgtctcggtctccgacggtatctcgatggggcacgagggaatgcacttctcgctcgtctcccgtgaggtcatcgccgactcggtcgagacggtcatgatggccgagcggctcgacggcaccgtcctcctcgccggctgcgacaaatcgctgccgggcatgctgatggccgcggcccgtctcgacctctccgcgatcttcctctacgcgggctccatcgcgcccggctgggtcaaactcagcgacggcaccgagaaggacgtcacgatcatcgactcgttcgaggctgtcggtgcgtgcaaggccggcaagatgagcgaggaggacctcaaacgcatcgagtgcgccatagccccgggtgaaggagcctgcggcggcatgtacaccgcgaacaccatggcgtccgtcgccgaggcactcgggatgagcctgcccggctcggctgcgccgccctcggccgaccggcggcgcgactccttcgcccaccgctccggcgaggctgttgtctccctgctgaagcagggcatcacggctcgcgacatcctcaccaagaaggcgttcgagaacgccatcgcggtggcgatggccttcggcgggtcgacgaacgtcgtgcttcacctgctcgccatcgcgcgcgaggccgaggttgacctcaccatcgacgatttcaaccgcatcggcgagacggttccgcacatcggcgatctcaaaccgttcggcacgtacgtcatgaacgacgtcgaccgtcacggtggtgtcccggtcgtcatgaaggcgctcctggacgcgggcctgctgcacggggactgcctcaccgtgaccggcaagaccgtcgcggagaacctggcggagatcgacccgcccgcaccggacggcaccgtcctgcgctcgctggacaaccccatccacccgacaggggggctcacaatcctcaagggcacgctcgctccggagggcgccgttgtcaagacggctggtttcgacgccgaggtgttcgagggcccagcgcgcgtgttcgagcgcgagcgcgccgctatggacgctctcaccgcgggccggatcaacgccggcgatgtggtcgtcatctgctacgaagggccgaagggcggtcccgggatgcgcgagatgctcgcgatcaccgccaccatcaagggtgcaggcctcggcaaggatgtactactcttgacggacgggcgattctcaggcggcacaaccggcctgtgcatcggccacatagcacccgaagcggtggacgctggtcccatcgcattcgtgcgcgatggtgatttgatacgggtcgatatcgcggctcgctccctcgacctactggtcgacgagtcagagctgaccgcccgccgggacggctgggcgcctcttcctccgcgctatacccgtggcgttctcgcgaagtactccaagctcgttcgctccgctgcggagggtgcggtcaccgggtag

SEQ ID NO: 32 - protein, 564 aa, Leifsonia xyli
MPQIDWKPRSRVVTDGIEATTSRGMLRAVGMGDADWEKPQIGIASSWNEITPCNLSLDRLAQGAKEGVHSGGGYPLQFGTVSVSDGISMGHEGMHFSLVSREVIADSVETVMMAERLDGTVLLAGCDKSLPGMLMAAARLDLSAIFLYAGSIAPGWVKLSDGTEKDVTIIDSFEAVGACKAGKMSEEDLKRIECAIAPGEGACGGMYTANTMASVAEALGMSLPGSAAPPSADRRRDSFAHRSGEAVVSLLKQGITARDILTKKAFENAIAVAMAFGGSTNVVLHLLAIAREAEVDLTIDDFNRIGETVPHIGDLKPFGTYVMNDVDRHGGVPVVMKALLDAGLLHGDCLTVTGKTVAENLAEIDPPAPDGTVLRSLDNPIHPTGGLTILKGTLAPEGAVVKTAGFDAEVFEGPARVFERERAAMDALTAGRINAGDVVVICYEGPKGGPGMREMLAITATIKGAGLGKDVLLLTDGRFSGGTTGLCIGHIAPEAVDAGPIAFVRDGDLIRVDIAARSLDLLVDESELTARRDGWAPLPPRYTRGVLAKYSKLVRSAAEGAVTG

SEQ ID NO: 33 - DNA, 1704 bp, Marine actinobacterium
atgtctgagagtgattcgattgatatcaagccacgttcccgcacggtaaccgacggaattgaagcaacaacttcgcgcggaatgctgcgtgcagttggtatgggagatgccgactgggagaagccccagatcggtattgcgagctcgtggaacgagatcaccccctgcaatctgtcgctcgatcgcctcgctcaagcggcgaaagagggagtgcacgccggtggcgggtacccactgcagtttggaacgattagcgtttccgatggcatttcaatggggcacgaggggatgcacttctcactcgtgagtcgcgaagttatcgctgactccgttgaggttgtcatggaggcagagcgcctcgacggttcggtcacgctcgcgggctgcgacaagtcgcttcccggaatgctgatggctgcggcgcggctcaacctcgcctctgtcttcctctatgccggttcgatcgctcccggctgggtcaagctcagcgacggtaccgaaaaagacatcacgatcatcgactcgttcgaagcagtcggcgcagtcaaagctggccggatgagcgaagccgacgccaagcgcatcgagtgtgcttttgcgcccggcgagggtgcctgtggcggtatgtacacggccaacacgatggcgagcgttgcggaagccctgggaatgagtcttcccggctcggcgagcccagcatccgccgatcgtcgtcgcgactacttcgcgcaccgttcaggcgaagctgtcgtcaatcttctgcgcctcggtatcacttcgcgcgacatcatgacgaagaaggcttttgagaacgcgatcacggtagcaatggctcttggtggctccacgaacgttgtgctgcacatcctcgccatcgcgagcgaagccgaagttgaactcacgctcgatgacttcaatcgcatcggcgacaaggttccccacttgggcgacctgaagccgttcggccagtacgtcatgaacgatgttgaccgccacggcgggctcccggtgctcatgaaggcgctcatggaggaggggctcattcacggcgatgccctcacagtgacgggcaagactgttgccgaaaacttggccgagatggacatcgatcctctagatggcaaggttcttcgcaagttcgacaaccccatccaccccactgggggtctcacaattcttaagggttctttcgctcccgagggtgcagtcgtgaagacggcaggtttcgacgttgctgagttcgtgggccctgcccgcgtgttcgagcgcgagcgtgaagcactggatgctttgactgccggcacgatcgaggctggttctgttgtcgtcattcgctatgaaggacccaagggtggaccgggcatgcgcgagatgctcgcgatcacggcggccatcaagggcgctggactcggcaaagatgtactactcttaacagacggacgattctcaggcggcacaaccggactgtgtatcggccacatagctcccgaagcagtagacgcaggtcctattgccttcgtgcgcgatggtgatcttatacgggtcgatatcgcagctcgctcgctcgacttacttgtcgactccgctgagctcgaagcccgccgaaaaggctgggcccccctccctccgcgctacacgcgaggtgttctggccaagtattcgaagcttgttcagtccgccgctcgcggcgcggtcaccagttag

SEQ ID NO: 34 - protein, 567 aa, Marine actinobacterium
MSESDSIDIKPRSRTVTDGIEATTSRGMLRAVGMGDADWEKPQIGIASSWNEITPCNLSLDRLAQAAKEGVHAGGGYPLQFGTISVSDGISMGHEGMHFSLVSREVIADSVEVVMEAERLDGSVTLAGCDKSLPGMLMAAARLNLASVFLYAGSIAPGWVKLSDGTEKDITIIDSFEAVGAVKAGRMSEADAKRIECAFAPGEGACGGMYTANTMASVAEALGMSLPGSASPASADRRRDYFAHRSGEAVVNLLRLGITSRDIMTKKAFENAITVAMALGGSTNVVLHILAIASEAEVELTLDDFNRIGDKVPHLGDLKPFGQYVMNDVDRHGGLPVLMKALMEEGLIHGDALTVTGKTVAENLAEMDIDPLDGKVLRKFDNPIHPTGGLTILKGSFAPEGAVVKTAGFDVAEFVGPARVFEREREALDALTAGTIEAGSVVVIRYEGPKGGPGMREMLAITAAIKGAGLGKDVLLLTDGRFSGGTTGLCIGHIAPEAVDAGPIAFVRDGDLIRVDIAARSLDLLVDSAELEARRKGWAPLPPRYTRGVLAKYSKLVQSAARGAVTS

SEQ ID NO: 35 - DNA, 1695 bp, Clavibacter michiganensis
atgcctgagatcgacatgaagccccggagccgcgacgtcaccgacgggatcgaggccaccgcagcacgcggcatgctccgcgccgtcgggatgggcgacgaggactgggcgaagccccagatcggcgtcgcgagctcctggagcgagatcaccccctgcaacctcagcctcgaccgcctcgcgcagggcgccaaggagggcgtgcacgcgggcggcggctacccgctccagttcggcaccatctccgtcagcgacggcatctcgatgggccacgagggcatgcacttctcgctcgtctcgcgcgaggtcatcgccgacagcgtcgagaccgtcatgatggccgagcgcctcgacgggtccgtgctcctcgcgggctgcgacaagtcgctccccggcatgctcatggccgcggcccgcctcgacctctcctcggtgttcctctacgcgggatccatcgcccccggctgggtcaagctctcggacggcaccgagaaggaggtcaccatcatcgacgccttcgaggcggtcggcgcctgcaaggccggcacgatgagccaggaggacctgacccgcatcgagaaggccatctgcccgggcgagggcgcatgcggcggcatgtacacagcgaacaccatggcgagcgtggccgaggccctcggcatgagcctccccggatccgccgccccgccgagcgccgaccgccgccgcgactacttcgcgcaccggtcgggcgaggccgtcgtcaacctcatcgcggagggcatcaccgcgcgcgacatcatgacgaaggaggcgttcgagaacgccatctccgtggtcatggcgttcggcggatccaccaacgcggtcctccacctcctcgccatcgcgcgcgaggccgaggtcgacctgcagctgtccgacttcaaccgcatcgccgaccgcgtgccgcacctcggcgacctcaagccgttcggccgcttcgtcatgaacgacgttgaccgcgtcggcggcgtccccgtcgtcatgaaggccctgctcgacgcgggcctcctgcacggcgacgtcatgaccgtcaccggccgcaccatgcgcgagaacctcgaggcgatggacctcgcggagctcgacggcacggtcatccggaagatggacgacccgatccacgccaccggcggcatcagcgtcctgcacggctccctcgcccccgagggcgcggtcgtgaagacggccggcttcgacctcgacgtgttcgagggccccgcccgcgtcttcgagcgcgagcgcgccgcgatggacgcgctcaccgagggactcatctcgaagggcgacgtcatcgtcatccgctacgagggccccaagggcggccccggcatgcgcgagatgctcgccatcacgggcgccatcaagggagccggcctcggcaaggatgtactactcttgacggacggtcgattctcaggcggcacaaccggactgtgcatcggccacatggctcccgaagcggtggacgcaggtcccgtcgccttcgtgcgcgatggagaccggatccgtgtcgacatcgccgctcgcacgctcgacctactggtcgacgaggccgagctcgccgcccgccgtgaggggtgggcacctctcccgccgcgctacacgcgcggggtcctcgccaagtacgccaagctcgtgcactcggccgccgagggcgcgatcacgggatga

SEQ ID NO: 36 - protein, 564 aa, Clavibacter michiganensis
MPEIDMKPRSRDVTDGIEATAARGMLRAVGMGDEDWAKPQIGVASSWSEITPCNLSLDRLAQGAKEGVHAGGGYPLQFGTISVSDGISMGHEGMHFSLVSREVIADSVETVMMAERLDGSVLLAGCDKSLPGMLMAAARLDLSSVFLYAGSIAPGWVKLSDGTEKEVTIIDAFEAVGACKAGTMSQEDLTRIEKAICPGEGACGGMYTANTMASVAEALGMSLPGSAAPPSADRRRDYFAHRSGEAVVNLIAEGITARDIMTKEAFENAISVVMAFGGSTNAVLHLLAIAREAEVDLQLSDFNRIADRVPHLGDLKPFGRFVMNDVDRVGGVPVVMKALLDAGLLHGDVMTVTGRTMRENLEAMDLAELDGTVIRKMDDPIHATGGISVLHGSLAPEGAVVKTAGFDLDVFEGPARVFERERAAMDALTEGLISKGDVIVIRYEGPKGGPGMREMLAITGAIKGAGLGKDVLLLTDGRFSGGTTGLCIGHMAPEAVDAGPVAFVRDGDRIRVDIAARTLDLLVDEAELAARREGWAPLPPRYTRGVLAKYAKLVHSAAEGAITG

SEQ ID NO: 37 - DNA, 1707 bp, Saccharopolyspora erythraea
gtgagcaccagcactgatggcacaggacagtcggggcgtggtctgaagccccgcagcggtgacgtgaccgaggggatcgaacgtgctgcggcgcgggggatgctccgggcggtcgggatgcaggacgccgacttcgcgaagccccagatcggggtggcgtcctcgtggaacgagatcacgccgtgcaacctgtcgttgcagcggctcgcgcaggcgagcaaggaaggtgtgcacgcggccggcggcttcccgatggagttcgggacgatctcggtctcggacgggatctcgatgggtcacgtcggcatgcactactcgctcgtgtcccgcgaggtcatcgccgactccgtcgagacggtgatggaggcggagcggctcgacgggtccgtgctgctcgccggctgcgacaagagcctgccgggcatgctgatggccgcggcgcgcctggacgtcgcggcggtcttcgtctacgccgggtcgatcctccccgggcgggtcgacgaccgcgaggtcaccatcatcgacgcgttcgaggcggtgggcgcctgcgcccgcggcctgatcagcgaggccgaggtcgaccgcatcgaacgcgccatctgcccgggagagggcgcgtgcggcggcatgtacaccgcgaacaccatggcctgcgcggcagaggcgatgggcatgtcgctgccgggatcggcgagcccgccgtcggtagaccggcggcgcgacgccggagcccgggaggccgggcgcgcggtggtcgggatgatcgagcgcggactgaccgcgcggcagatcctgaccaaggaggcgttcgagaacgccatcgccgttgtgatggcgttcggtggctccaccaatgccgtgctgcacctgttggcgatcgcgcgggaagccgaggtcgacctgacgctcgacgacttcaaccgcatcggtgaccgcgtcccgcacctcgccgacgtcaagcccttcggtcggcacgtgatgaccgcggtggaccggatcggtggcgtgccggtcgtgatgaaggccctgctcgacgccgggttgctgcacggcgactgcatgacggtcaccgggaagacggtggccgagaacctcgccgagctggatccgccggagctcgacggtgaggtcctgcacaagctgtcgaacccgctgcacccgaccggcgggctgacgattctgcgcggatcgctcgccccggaaggtgcggtggtcaagagcgccgggttcgactccgccactttcgaaggcacggcgcgggttttcgacggcgagcagggtgcgatggacgccgtcgaagacggctcgttgaaggccggcgacgtggtggtgatccggtacgaagggccgcgcggtggtccgggtatgcgcgagatgctcgcggtcaccggtgccatcaagggcgcgggcctgggcaaggacgtcctgctgctgacggacggccgtttctccggcggtaccacggggctgtgcatcggtcacgtggctcccgaggcgaccgacggcgggccgatcgcgttcgtgcgcgacggggacccgatccggctcgacctggcgggccggacgctcgacctgctggtggacgaagccgaactcgcgcgccggaaggaaggctgggtgccgcgggagccgaagttccggcagggcgtgctcgggaagtacgcgcggctggtccggtcggcggcggtgggcgcggtctgctcctga

SEQ ID NO: 38 - protein, 568 aa, Saccharopolyspora erythraea
MSTSTDGTGQSGRGLKPRSGDVTEGIERAAARGMLRAVGMQDADFAKPQIGVASSWNEITPCNLSLQRLAQASKEGVHAAGGFPMEFGTISVSDGISMGHVGMHYSLVSREVIADSVETVMEAERLDGSVLLAGCDKSLPGMLMAAARLDVAAVFVYAGSILPGRVDDREVTIIDAFEAVGACARGLISEAEVDRIERAICPGEGACGGMYTANTMACAAEAMGMSLPGSASPPSVDRRRDAGAREAGRAVVGMIERGLTARQILTKEAFENAIAVVMAFGGSTNAVLHLLAIAREAEVDLTLDDFNRIGDRVPHLADVKPFGRHVMTAVDRIGGVPVVMKALLDAGLLHGDCMTVTGKTVAENLAELDPPELDGEVLHKLSNPLHPTGGLTILRGSLAPEGAVVKSAGFDSATFEGTARVFDGEQGAMDAVEDGSLKAGDVVVIRYEGPRGGPGMREMLAVTGAIKGAGLGKDVLLLTDGRFSGGTTGLCIGHVAPEATDGGPIAFVRDGDPIRLDLAGRTLDLLVDEAELARRKEGWVPREPKFRQGVLGKYARLVRSAAVGAVCS

SEQ ID NO: 39 - DNA, 1677 bp, Acidothermus cellulolyticus
atgcgcgctcagcccgatctcaaaccgcgcagccgtgacgtcaccgatgggctggagcgggccgcggcccgcggcatgctccgcgccgtcggaatgaccgatgcggactgggagaaaccccagatcggagtggcgagttcctggaacgagataacgccctgcaacctctccctcgaccggctcgcgcaggcggccaaggagggcgtgcacgccgccggcgggtatccgctggagttcgccaccatctcggtttccgacggcatctccatgggccatgagggaatgcatttctcgctgatttcccgcgaagtcatcgccgattccgtcgaaaccgtcttcatggctgagcgcttcgacggcgccgtcctgcttgccggttgcgacaagtccgaacccggcatgctgatggcggccgcccggcttgacctggcagcggttttcctctatgccggcagcacgttgccggggaaactcggggaccgggacatcaacatcgtcgatgcgttcgaggctgtcggcggttgccttcgcggcctggtgagccgggaagaggtcgacgccatcgaacggaatttctgtccggtcgaaggggcctgcgcgggcatgttcaccgccaacacgatggccagcgcggcggaagcgctcggcatgtcattgcccggttcggcctcgccgcccgcgccggaccgccggcgcgacggtttcgcccgggcctccggggaggcagtcgtcaacctgctccgccgcggcatcaccgcccgggacatcatgacccgggaggcattcgagaacgcgatcgctgtcgtgatggccctgggcggctccaccaacgccgtgctccatctgctcgcgatcgcccgcgaggcgaacgtcgacctcgccatcgacgatttcaaccggatcggggaccgggtcccgcacttggcggatgtcaagccgttcggccggtacgtgatgagtgacgtcgaccgggtcggcggcgtgcccgtggtgatgaaagcgctgctggacgccgggctgctgcacggcgactgcctgacggtgaccggcaagacggtggcggagaacctcgcggacatcaccccgccggaccccgacggcaaggtgattcacgcgctcacccaaccgatccaccgcaccggcgggctggccattctccgcggttcgctcgccccggacggcgcggtggtgaagaccgccgggctggagtcgacgttcttcgaaggcaccgcccgggtgttcgacggcgaggaggcggccatgcgcgccgtgcccgagctgcgtccgggagatgtcgttgtcatccggtacgaggggccgaaaggcggcccagggatgcgggagatgctcgcggtcaccggcgccatcaagggcgcgggcctcggcaaggatgtgctcctcgtcaccgacggccggttctccggcggtaccacgggtttctgtgtcgctcacgttgctccggaggcggtggacgggggaccgatcgcgttcgtccgggacggtgaccgcatccggctggacgcgcaggcccgtaccctcgacctgctggtggacgccgatgagctggccaaacgacgggccgactggcaaccgccgccgccgcggtacaccaccggagtcgcggccaagtacgtcaagctggttggcagcgcctccgagggtgcgatctgtcggtga

SEQ ID NO: 40 - protein, 558 aa, Acidothermus cellulolyticus
MRAQPDLKPRSRDVTDGLERAAARGMLRAVGMTDADWEKPQIGVASSWNEITPCNLSLDRLAQAAKEGVHAAGGYPLEFATISVSDGISMGHEGMHFSLISREVIADSVETVFMAERFDGAVLLAGCDKSEPGMLMAAARLDLAAVFLYAGSTLPGKLGDRDINIVDAFEAVGGCLRGLVSREEVDAIERNFCPVEGACAGMFTANTMASAAEALGMSLPGSASPPAPDRRRDGFARASGEAVVNLLRRGITARDIMTREAFENAIAVVMALGGSTNAVLHLLAIAREANVDLAIDDFNRIGDRVPHLADVKPFGRYVMSDVDRVGGVPVVMKALLDAGLLHGDCLTVTGKTVAENLADITPPDPDGKVIHALTQPIHRTGGLAILRGSLAPDGAVVKTAGLESTFFEGTARVFDGEEAAMRAVPELRPGDVVVIRYEGPKGGPGMREMLAVTGAIKGAGLGKDVLLVTDGRFSGGTTGFCVAHVAPEAVDGGPIAFVRDGDRIRLDAQARTLDLLVDADELAKRRADWQPPPPRYTTGVAAKYVKLVGSASEGAICR

SEQ ID NO: 41 - DNA, 1704 bp, Corynebacterium efficiens
atgaccaacgatcatgacatcgatatcaagccacgttcacgcgatgtgaccgacggcctggaacgcaccgccgcccggggcatgctccgggcagtcggcatgggcgacgacgactgggagaaaccccagatcggtgtggccagctcctggaatgaaatcaccccctgtaatctcacgctgaagaagcttgctggatttgccaaggagggtgtccacgaggcggggggttaccccctggagttcgggaccatctccgtctccgacggtatctccatgggccacgagggcatgcactattccctggtatcccgcgaggtcatcaccgactccgtggaaaccgtcatgagtgccgagcgactggacggttctgttctactcgccggctgtgacaaatccattcccggcatgctcatggccgccgcccggttgaatctgtcctcggtgttcctctacaacggatccaccatgccgggcaccgcgaagatgtccgacggtacggagcgggaggtcaccctcatcgatgccttcgaggccgtcggagcctgtcgtgcgggaaccatgagccgggaggacgtggatgccattgaacgctccgtgtgccccggggagggtgcctgtggcggcatgtacacagccaacaccatggcctcggctgctgaggccatgggcatgtccctgcccggttccgccgctcccccggcgatccaccaggaccgcaccctctatgcccgccgttccggcgaggcggtggtggaactgctgcgcaggggaatccgtgcccgtgacatcatcacacgggaatcactgctcaatgccgtcgccgtggtcatggcgctgggtggctccaccaacgcggttctgcacctcatggccatcgcccacgaggccgaggtggatctcaccttggaggacttcaacgccgtcggcgacaaggtcccccaccttggtgacctcaaacccttcggccggtatgtgatgaacgacgtattcaagatcggcggcatccccgtggtgatgaaagcgcttctcgacgccggcctcatcaacggcgactgcctcaccatcaccggccggaccgttgcggagaacctccagggcatcaacccaccggatcccgacggccagatcctacgggccattgacaacccgatccacaagaccggtgggctgaccatcctgcacggttccctcgcaccgggtggtgccgtggtcaaaaccgctggtttcgacaccgaacgcttcgagggcaccgcccgtgtcttcaaccaggaagcacccgccatggatgcggtgctcaacggtgaactgaaggctggcgacgtggtgatcatccgctacgagggaccgaagggcggccccggcatgcgcgagatgctcgccatcaccggtgccatcaagggtgccggcatcggcaaggaggtgctgctcatcaccgacggtcgtttctccggtgggtccaccggcctgtgcatcgggcatgtggcccccgaggccgtcgacggcggacctatcgccctcgttgaagacggcgatcccatcctggtcgacatcagccaacgacgtatcgatctcctggtagacgaatccattctggaggagcgcaggaaaaccctgcagcatccggagaatccacgtctccacggcgtgctggggaagtacgccaagctggtgcagtcagcctcaatgggcgcggtctgcttctag

SEQ ID NO: 42 - protein, 567 aa, Corynebacterium efficiens
MTNDHDIDIKPRSRDVTDGLERTAARGMLRAVGMGDDDWEKPQIGVASSWNEITPCNLTLKKLAGFAKEGVHEAGGYPLEFGTISVSDGISMGHEGMHYSLVSREVITDSVETVMSAERLDGSVLLAGCDKSIPGMLMAAARLNLSSVFLYNGSTMPGTAKMSDGTEREVTLIDAFEAVGACRAGTMSREDVDAIERSVCPGEGACGGMYTANTMASAAEAMGMSLPGSAAPPAIHQDRTLYARRSGEAVVELLRRGIRARDIITRESLLNAVAVVMALGGSTNAVLHLMAIAHEAEVDLTLEDFNAVGDKVPHLGDLKPFGRYVMNDVFKIGGIPVVMKALLDAGLINGDCLTITGRTVAENLQGINPPDPDGQILRAIDNPIHKTGGLTILHGSLAPGGAVVKTAGFDTERFEGTARVFNQEAPAMDAVLNGELKAGDVVIIRYEGPKGGPGMREMLAITGAIKGAGIGKEVLLITDGRFSGGSTGLCIGHVAPEAVDGGPIALVEDGDPILVDISQRRIDLLVDESILEERRKTLQHPENPRLHGVLGKYAKLVQSASMGAVCF

SEQ ID NO: 43 - DNA, 1713 bp, Brevibacterium linens
atgagcattgatacgaactccaccaaaccggacatcaaaccacgttctcgcgacgtcaccgacggtctcgaagccaccgctgcgcgcggcatgctgcgtgccgtgggaatgggcgatgacgactgggtcaagccgcagatcgccatcgcgacctcgtggaacgagatcaccccgtgcaacatgtccctgcagcgcctcggtgcggccgccaaggaaggcgtgcacgaatcgggcggattccccctggaattcggcaccatctccgtctccgacggcatctccatgggccacgagggcatgcactactcgctggtctcgcgcgaggtcatcaccgactccgttgagaccgtgatgagcgccgaacgactcgacggatcggtcctcatggccggctgcgacaagtcgatcccgggcatgctcatggcatccgcccgcctcggcctctccagcgtattcctctacaacggctcgatcatgccgggtaccgcgaagatggaggacggcaccgagaaggaagtcaccctcatcgacgccttcgaagcagtcggcgcctgccgtgccggaaccatcagccaaaaagacgtcgactccatcgagcgcgccgtctgcccgggtgaaggcgcctgtggtggcatgtacaccgcgaatacgatggcctcggccgccgaggccatgggcatgtccctgccaggctcggccgcacctcctgccatccaccgcgaccgcacgatgttcgcgcgcaaatccggtgatgctgtcgtcaacctgctgcgtcagggaatcacgacgaaggacatcatcacccgcgaatcgctgcacaacgcgatcgccgtggtcatggccttcggcggatcgaccaacgcggttctccacctcctggccatcgcccacgaggccggagtcgaactcgccctcgatgacttcaaccgcatcggcgacaaggtcccgcacctgggcaacgtcaaacccttcggccagtacgtgatgaacgatgtgttcaagatcggcggcgtgccggtgatcatgaaggctctgctcgacaacggaatgctcaacggcgactgcatgaccgtgacgggaaagaccgtggcggagaacctcgagacgatcaacccgccggaccccgacggcaagatcctgcgcgcgctcaacaacccgattcacgccaccggcggcctcaccgtgctcaagggctcgttggctcccgaaggtgcagtcgtgaagtccgccggcttcgatgccgacgtcttcgaaggcaccgctcgcgtgttcaaccaggagaagccggccatggatgccgtcctcaacggtgagctgaagaagggcgatgtcgtcgtcatccgctacgaaggacccaagggcggacccggtatgcgcgagatgctcgccatcaccggtgcgatcaagggcgcgggaatcggcaaggacgtcctgctcatcaccgacggacgcttctccggcggatcgacgggactgtgcatcggtcacgtggcgcccgaggccgtcgacggcggaccgatcgcactcgtcgaggacggcgacaagatcaccgtcgacatcgcggcacggtccatcgacctgcatgttgacgagtcggtgctcgaagagcgtcgcaagacctggacgattcccgagaaccaccgcctcaccggtgtgctcggaaagtacgcgaagctcgtgcagtcggcctccaccggtgccgtctgcttctga

SEQ ID NO: 44 - protein, 570 aa, Brevibacterium linens
MSIDTNSTKPDIKPRSRDVTDGLEATAARGMLRAVGMGDDDWVKPQIAIATSWNEITPCNMSLQRLGAAAKEGVHESGGFPLEFGTISVSDGISMGHEGMHYSLVSREVITDSVETVMSAERLDGSVLMAGCDKSIPGMLMASARLGLSSVFLYNGSIMPGTAKMEDGTEKEVTLIDAFEAVGACRAGTISQKDVDSIERAVCPGEGACGGMYTANTMASAAEAMGMSLPGSAAPPAIHRDRTMFARKSGDAVVNLLRQGITTKDIITRESLHNAIAVVMAFGGSTNAVLHLLAIAHEAGVELALDDFNRIGDKVPHLGNVKPFGQYVMNDVFKIGGVPVIMKALLDNGMLNGDCMTVTGKTVAENLETINPPDPDGKILRALNNPIHATGGLTVLKGSLAPEGAVVKSAGFDADVFEGTARVFNQEKPAMDAVLNGELKKGDVVVIRYEGPKGGPGMREMLAITGAIKGAGIGKDVLLITDGRFSGGSTGLCIGHVAPEAVDGGPIALVEDGDKITVDIAARSIDLHVDESVLEERRKTWTIPENHRLTGVLGKYAKLVQSASTGAVCF

SEQ ID NO: 45 - DNA, 1710 bp, Tropheryma whipplei
gtgtttatgtcgagcgatgcaaatgcctgtgaaatagatataaagccgagaagccgagtcgtaacccatgggatcgaggcgacaacatcgcgtggtatgctgcgcgccgttggaatgggtgatgctgattgggaaaaaccacagattggcattgcatccagttggaataacataactccgtgcaatttgtcacttgacagacttgcgcagggtgcaagggaaggtgttcacgcagccggtgggtatccgctgcagttttgcactatatcggtttccgacggaatctctatgggtcatgagggaatgcatttttctcttgtttctcgcgaagttattaccgacagcgtggaaaccgttctgatggcagaggcactggatggtgttgttcttcttgctggctgtgataaatccctcccgggtatgcttatggcagctgcaaggcttgatgtgtctgcagtatttctatatgccggcagtattgcccccggttatgtcacactcaagtgtggcgagtcaaaagaagttacaataattgattcattcgaagccgttggtgcctataaggcagggcttattgatcaggatgatcttggccggattgaaagggccatatgccccggggagggcgcatgtggcggcatgtatacggcaaacacaatggcatctgttgcagaagcgcttggtatgagtcttttgggttcggcaagtccaccctcggcagatcgtcgtcgtgatgtttatgcacataagtcgggcgaggcggttgttgagctcctgaagcggggtataaccgcaagagatattttgacaaaagaggcatttgaaaatgcgatagcagttgttatggcccttggcggatctacaaacgccgttttgcatttacttgcgatagctcatgaggcccatgtgccactgacgatagacgattttaacaaaatcgggaatagggttcctcatattgcagacctcaagccttttgggcgctatgtaatgaatgatgtagatcgcgtgggaggtattccagttgttataaatgcattgatgcgggaaggttttatacacggtgatgtaattaccgtttcaggcagaacaatggccgaggagatatctgatatcaatccgggccttcccgacggaaaggttatacactctttttcctcacctctgcacccaacaggcggtataaaggtattaaaaggtacgcttgcaccggatggggccgttgcaaaaacagctggtttcgatactgtggtttttcaaggccccgcaatggtgtttgatcgcgagcgcgcggctatggatgctctcagtgctgggaatataaaaaaggggagcgttattgttattcgctatgaaggcccaaaagggggtccgggtatgcgagagatgctggctattaccgcggcaataaagggaagtggccttggtaaagatgttttattgttgacagacggcaggttctcgggcggtacaaccggtctgtgtatagggcatattgcgccagaggcggttgatcttgggccgattgcgtttgtgcaagatggcgatataatccgcgttgatattgagaaatcgagtattgatgttctggttgatgaaaagcaattgcgcgccaggcacttgactccacccccacccaggtatacaagcggtgttctttcaaaatattcaaaactcgtcaaatctgcttctttgggtgcaataacttag

SEQ ID NO: 46 - protein, 569 aa, Tropheryma whipplei
MFMSSDANACEIDIKPRSRVVTHGIEATTSRGMLRAVGMGDADWEKPQIGIASSWNNITPCNLSLDRLAQGAREGVHAAGGYPLQFCTISVSDGISMGHEGMHFSLVSREVITDSVETVLMAEALDGVVLLAGCDKSLPGMLMAAARLDVSAVFLYAGSIAPGYVTLKCGESKEVTIIDSFEAVGAYKAGLIDQDDLGRIERAICPGEGACGGMYTANTMASVAEALGMSLLGSASPPSADRRRDVYAHKSGEAVVELLKRGITARDILTKEAFENAIAVVMALGGSTNAVLHLLAIAHEAHVPLTIDDFNKIGNRVPHIADLKPFGRYVMNDVDRVGGIPVVINALMREGFIHGDVITVSGRTMAEEISDINPGLPDGKVIHSFSSPLHPTGGIKVLKGTLAPDGAVAKTAGFDTVVFQGPAMVFDRERAAMDALSAGNIKKGSVIVIRYEGPKGGPGMREMLAITAAIKGSGLGKDVLLLTDGRFSGGTTGLCIGHIAPEAVDLGPIAFVQDGDIIRVDIEKSSIDVLVDEKQLRARHLTPPPPRYTSGVLSKYSKLVKSASLGAIT

SEQ ID NO: 47 - DNA, 1731 bp, Methylobacterium extorquens
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaagcccaggccgtgaagaagggtgtcgccgccgccaagggcactccgcgcgagttctgcaccatcaccgtcaccgacggcatcgccatgggccatggcggtatgcgcgcctcgctgccttcccgcgaggtcatcgccgattcggtcgagctgacgatccgcggccattcctacgacgccctcgtggggctggccggctgcgacaagtccctgcccggcatgatgatggccatggtgcgcctcaacgtgccctcgatcttcatctatggcggctcgatcctgccgggctcgttccgcggccggccggttacggtgcaggatctgttcgaggcggtcggcaaggtcgccgtcggcgacatgagcctcgacgacctcgacgagctggagcgggttgcctgcccctcggccggcgcctgcggcgcgcagttcaccgccaacaccatggccaccgtctccgaggcgatcggcctcgcgctgccctactcggccggcgcgcctgccccttacgagatccgcgaccaattctgcgccgccgccggcgagaaggtgatggagctgatcgccaagaacatccgcccgcgcgacatcgtcacccgcaaggcgctggagaacgccgccgcgacggtcgcggcctcgggcggctcgaccaacgcggccctgcacctgccggcgatcgcgcatgaatgcggcatcgagttcaccctgttcgacgtcgccgagatcttccgcaagaccccctacatcgccgacttgaagcccggcgggcgctatgtggccaaggacatgttcgaggtcggcggcatcccgctgctgatgaagacgctgctcgaccacggctacctgcacggcgactgcctcaccgtcaccggccgcaccatcgccgagaacctcgccaaggtcgcctggaacccggatcaggacgtggtgcgcccggccgacaagcccatcaccgtcaccggcggcgtggtgggcctgcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttctccggcgcgacccgcggcttctgcgtcggccatgtcggccccgaggctgccatcggcgggccgatcggcctgctgcgcgacggcgacatcatcaccctcgatgcgatcaagggcacgctcgacgtggcgctctccgacgaggaactggcccagcgtcgcagcgaatggacgccgcggggcaatgccgcgacctccggctacctctggaaatacgcgcagtccgtcgggcctgcagtgaacggggccgtgacgcatccgggcggcgcgggggagacgaacgtctatgccgacatctag

SEQ ID NO: 48 - protein, 576 aa, Methylobacterium extorquens
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWTPRGNAATSGYLWKYAQSVGPAVNGAVTHPGGAGETNVYADI

SEQ ID NO: 49 - DNA, 1734 bp, Methylobacterium nodulans
atggacgcgcgtcacaccatcgacaagtcgaagctgccgagccgctatgtcaccgaggggccggcccgggcgccgcatcgctcgtatctctatgcgatggggctgacgcgggagcagatccaccagccgctggtgggcgtcgcctcctgctggaacgaggccgccccctgcaacatcgcgctcatgcgccaggcgcaggcggtgaagaagggcgtcgccgccgcggccggtaccccgcgggaattctgcaccatcacggtcaccgacggcatcgccatgggccaccggggcatgcgcgcctcgctgccctcccgggaggtcatcgccgattccgtcgagctcaccatgcggggccacgcctacgacgccctggtggggctcgcgggctgcgacaagtccctgcccggcatgatgatggcgatggtgcgcctgaacgtgccgtcgatcttcatctatggcggctcgatcctgcccggctccttccgcgggcggccggtcacggtccaggacctgtttgaggcggtcggcaagcactccgtcggccagatgagcgacgaggatctggacgagctggagcaggtcgcctgcccgtcggccggcgcctgcggggcgcagttcaccgccaacacgatggcgaccgtctccgaggcgatcggcctcgcgctgccctattcggccggcgcgcccgctccctacgagatccgcgacaagttctgcgcggcggccggcgagatggtgatggatctcctcgccaagaacatccgcccgcgcgacatcatcacccgcaaggcgctggagaacgccgccacggtggtcgccgcctccggcggctcgaccaatgcggcgctgcacctgccggccatcgcccacgaggcgggcatcgtcttcgacctgttcgacgtcgccgagatcttccggcgcacgccctacatcgccgacctcaagccgggcgggcgctacgtcgccaaggacctgttcgaggccggcggcatcccgctcctgatgaagaccctgctggaccacggcttcctgcacggcgactgcatcaccgtgaccggccgcaccatcgccgagaacctcgccaaggtggcctggaacccggaccaggacgtcgtgcggccggccgacaccccgatcaccccgaccggtggcgtggtcggcctcaagggcaacctcgcccccgagggcgcgatcgtgaaggtcgccggcatgccggccgaccgccaagtattcgccggcccggcccgcgtcttcgacaacgaggaagcctgtttcgaggcggtgcagaaccgccagtacaaggagggcgacgtcctcgtcatccgctacgagggcccgaagggcggccccggcatgcgcgagatgctggcgaccaccgccgccctctacggccagggcatgggcgacaaggtcgcgctcatcacggacggccgcttctcgggcgcgacccgcggcttctgcgtcggccatgtcgggcccgaggccgcaatcggcggcccgatcggccttctcaaggacggggacatcatccggctcgacgcgatccagggcatcctctcggtcgatctctccgacgaggaactggccgagcgccgcaaggcctggaccccgcgcgcgaacgaggcgacctccggctatctctggaaatacgcgcagaccgtcggcccggcggtgaccggcgccgtgacgcatccgggcggagcccaggagacgctcacctatgcggacatctga

SEQ ID NO: 50 - protein, 577 aa, Methylobacterium nodulans
MDARHTIDKSKLPSRYVTEGPARAPHRSYLYAMGLTREQIHQPLVGVASCWNEAAPCNIALMRQAQAVKKGVAAAAGTPREFCTITVTDGIAMGHRGMRASLPSREVIADSVELTMRGHAYDALVGLAGCDKSLPGMMMAMVRLNVPSIFIYGGSILPGSFRGRPVTVQDLFEAVGKHSVGQMSDEDLDELEQVACPSAGACGAQFTANTMATVSEAIGLALPYSAGAPAPYEIRDKFCAAAGEMVMDLLAKNIRPRDIITRKALENAATVVAASGGSTNAALHLPAIAHEAGIVFDLFDVAEIFRRTPYIADLKPGGRYVAKDLFEAGGIPLLMKTLLDHGFLHGDCITVTGRTIAENLAKVAWNPDQDVVRPADTPITPTGGVVGLKGNLAPEGAIVKVAGMPADRQVFAGPARVFDNEEACFEAVQNRQYKEGDVLVIRYEGPKGGPGMREMLATTAALYGQGMGDKVALITDGRFSGATRGFCVGHVGPEAAIGGPIGLLKDGDIIRLDAIQGILSVDLSDEELAERRKAWTPRANEATSGYLWKYAQTVGPAVTGAVTHPGGAQETLTYADI

SEQ ID NO: 51 - DNA, 1725 bp, Rhodopseudomonas palustris
atggacgcgaaggcgacgctcaagtcgaagctccccagccggcacgtgaccgaagggccggcgcgcgcgccccatcgctcttacctctacgccatgggcctcaccaccgagcagatccaccagccgttcgtcggggtggcgtcgtgctggaacgaggccgcgccctgcaacatttcgctgatgcggcaggctcaggcggtcaagaagggcgtcgcctccgccggcggcaccccgcgcgaattctgcaccatcaccgtgactgacggcatcgccatgggccacgagggcatgcgctcgtcgctgccgtcgcgcgaggtgatcgccgactccgtcgagctgacaatccgcggccactcctatgacgcgctggtcgggctggccggctgcgacaagtctctgcccgggatgatgatggcgatggtccggctcaacgtgccgtcgatcttcatctatggcggctcgatcctgccgggcaccttccggggccagcaggtcaccgttcaggacatgttcgaggcggtcggcaagcactcggtcggcgagatgtcggacgacgacctcgacgaaatcgagcgggtcgcctgtccgtcggccggcgcctgcggcgcgcagttcaccgccaacaccatggcgaccgtgtccgaggcgatcggcctagcgctgccgtattcggccggcgcacctgctccttacgaaatccgcgatgcgttctgcacggcggccggcgagaaggtgatggagctgatcgccgccaacatccggccgcgcgacatcgtcacccgcaaggcgctggagaatgcggccgcggtggtagcagcgtccggcggctcgaccaatgctgcgctgcacctaccagcgatcgcgcatgaatgtggtatcaagttcgatctgtttgatgtcgccgaaatcttcaaaaagacaccatatatcgcggatttgaagccaggcggccgttatgtcgccaaagacatgtatgaagttggcggcataccgctcctgatgaagaccctgctcgatcatggcttcctccacggcgactgcctgaccgtcacgggacggacgatcgccgagaatctgaaagccgtgaagtggaatccgcatcaggacgtggtgcggcaggcgaaccatccgatcaccgtgactgggggcgtcgtcgggctgaagggaaacctcgcaccagaaggtgcgatcgtgaaggtcgcgggaatgtcgaacctgaagttttccgggcctgcccgctgcttcgatcgcgaggaagacgcgttcgaggcggtgcagaagcggacctacaaggaaggcgaggtcctcgtgatccgctacgaggggccgcggggcggccccggaatgcgggaaatgctcgccaccactgcggcgctgaccggccagggcatgggcggcaagatcgcgctgatcaccgacggccggttctccggcgccacccgcggcttctgcatcggccatgtcggcccggaagcggcgctgggtggtccgatcgcgctgctgcgcgacggtgacatcatcgtcatcgacgccgaggccggaacgcttgacgtaaatttgaccgacgacgaactggccgcgcgcaagtccgaatgggcgcatcgcgcgacaaaccacacgtcgggtgcgctttggaaatatgcccagcaggtcgggcccgcagtcagcggcgctgtgactcatccgggcggggcggccgagaagcagtgctatgcggatgtttga

SEQ ID NO: 52 - protein, 574 aa, Rhodopseudomonas palustris
MDAKATLKSKLPSRHVTEGPARAPHRSYLYAMGLTTEQIHQPFVGVASCWNEAAPCNISLMRQAQAVKKGVASAGGTPREFCTITVTDGIAMGHEGMRSSLPSREVIADSVELTIRGHSYDALVGLAGCDKSLPGMMMAMVRLNVPSIFIYGGSILPGTFRGQQVTVQDMFEAVGKHSVGEMSDDDLDEIERVACPSAGACGAQFTANTMATVSEAIGLALPYSAGAPAPYEIRDAFCTAAGEKVMELIAANIRPRDIVTRKALENAAAVVAASGGSTNAALHLPAIAHECGIKFDLFDVAEIFKKTPYIADLKPGGRYVAKDMYEVGGIPLLMKTLLDHGFLHGDCLTVTGRTIAENLKAVKWNPHQDVVRQANHPITVTGGVVGLKGNLAPEGAIVKVAGMSNLKFSGPARCFDREEDAFEAVQKRTYKEGEVLVIRYEGPRGGPGMREMLATTAALTGQGMGGKIALITDGRFSGATRGFCIGHVGPEAALGGPIALLRDGDIIVIDAEAGTLDVNLTDDELAARKSEWAHRATNHTSGALWKYAQQVGPAVSGAVTHPGGAAEKQCYADV

SEQ ID NO: 53 - DNA, 1725 bp, Rhodopseudomonas palustris
gtggacgccaactccaacatcaaggcgaggttgcccagccgtcacgtgacggaaggcccggagcgtgcgccgcaccgctcctacctctatgcgatggggttgaccacgcagcagatccaccagccgttcgtcggcgtggcatcgtgctggaatgaagccgcgccctgcaacatctcgctgatgcgccaggcccaggcggtgaagaagggcgtcgccgccgcgggtggtacgccacgcgaattctgcaccatcaccgtcaccgacggcatcgccatgggccatgacggcatgcgctcgtcgctgccgtcgcgcgaatgcatcgccgactcggtcgagctgaccatccgcggccactcctacgacgcgctggtcgggcttgccggctgcgacaagtcgctgcccggaatgatgatggcgatggtccggctcaacgtgccgtcgatcttcatctatggcggctcgatcctgcccggcaccttccgcggccagcaggtcaccgtgcaggacatgttcgaggcggtcggcaagcattcggtcggcgcgatgtcggacgccgacctcgacgaaatcgaacgggtggcgtgcccctcggccggcgcctgcggcgcccagttcaccgccaacaccatggcgacggtgtcggaggcgatcggcctggcgctgccttattcggccggagcacctgcgccctatgagatccgcgacgccttctgcatgaccgccggcgagcagatcatgacgctgatcgccaagaatatccggccgcgcgacatcgtcaccttgaaggcgctgcagaacgccgcggcggtggtggcggcctccggcggctcgaccaatgcggcgctgcacctgccggcgatcgcgcatgaatgcggcatcaaattcgacctgttcgacgtcgccgaaatcttcaaaaagacaccctatgtcgcggatttgaaacccggcggccgttatgtcgccaaagacatgtacgaagttggtggcataccgcttctgatgaaaacattgctcgatcatggctacctgcacggcgactgcctgacggtcaccggccggacgattgcggaaaatttggcaaccgtgaaatggaatcccgaccaggacgtggtgcgcgcagcggataacccgatcaccgtgaccggtggggtggtcgggctgcaaggcaacctcgcccccgagggggcgatcgtgaaggtcgccgggatgtccaacttgaaattctccggcccggcgcgctgcttcgatcgcgaagaggacgccttcgaggcggtgcagcacaagacctatcgcgaaggcgaagtgatcgtgatccgctacgaagggccgcgcggcggccccggcatgcgcgagatgctgtcgaccaccgcggcgctgaccgggcagggcatgggcggcaagatcgcgctgatcaccgacggccggttctccggcgccacccgcggcttctgcatcggccatgtcggaccggaagccgcgctcggcggcccgatcgcgctgttgcaggacggcgacatcatcgagatcgacgcggtggccggcacgcttaacgtaaaattgaccgaagccgaactctccgcgcgcaagaccaattggcagccgcgtgagaccaaccattcgtcaggcgcgttgtggaagtatgcccaacaggtcggccccgcgctcggtggcgcggtgacccatccgggtggttcgcacgagaaacagtgttatgcggatgtttaa

SEQ ID NO: 54 - protein, 574 aa, Rhodopseudomonas palustris
MDANSNIKARLPSRHVTEGPERAPHRSYLYAMGLTTQQIHQPFVGVASCWNEAAPCNISLMRQAQAVKKGVAAAGGTPREFCTITVTDGIAMGHDGMRSSLPSRECIADSVELTIRGHSYDALVGLAGCDKSLPGMMMAMVRLNVPSIFIYGGSILPGTFRGQQVTVQDMFEAVGKHSVGAMSDADLDEIERVACPSAGACGAQFTANTMATVSEAIGLALPYSAGAPAPYEIRDAFCMTAGEQIMTLIAKNIRPRDIVTLKALQNAAAVVAASGGSTNAALHLPAIAHECGIKFDLFDVAEIFKKTPYVADLKPGGRYVAKDMYEVGGIPLLMKTLLDHGYLHGDCLTVTGRTIAENLATVKWNPDQDVVRAADNPITVTGGVVGLQGNLAPEGAIVKVAGMSNLKFSGPARCFDREEDAFEAVQHKTYREGEVIVIRYEGPRGGPGMREMLSTTAALTGQGMGGKIALITDGRFSGATRGFCIGHVGPEAALGGPIALLQDGDIIEIDAVAGTLNVKLTEAELSARKTNWQPRETNHSSGALWKYAQQVGPALGGAVTHPGGSHEKQCYADV

SEQ ID NO: 55 - DNA, 1725 bp, Bradyrhizobium sp.
atggacgcgaagaccgacatcaagcgcaggctgcccagccgtcatgtgacggaagggccggagcgtgcgcctcatcggtcgtatctctacgcgatgggcctgaccacggcccaaatccatcagcccttcgtcggcgtcgcctcgtgctggaacgaggccgcgccctgcaacatcgcgctgatgcggcaggcgcaagccgtgaagaagggcgtggcccacgccggcggcacgccgcgcgaattctgcaccatcaccgtgaccgacggcatcgccatgggccatgacggcatgcgctcgtcgctgccgtcgcgcgaggcgattgccgattcggtcgagctgacgattcgcggtcatgcctacgacgcgctggttggcctcgccggctgcgataaatcgctgccgggcatgatgatggcgatggtccggctcaacgtgccgtcgatcttcatttatggaggctcgatcctgcccggcaatttccgcggccagcaggtcaccgtgcaggacatgttcgaggcggtcggcaagcattcggtcggcgcgatgtcggatgaggatctcgacgagctcgagcgcgtcgcctgtccgtcggccggtgcgtgcggtgctcagttcacggccaacacgatggcgaccgtctccgaggcgatcggcctggcgctgccgtactcggctggcgcgcccgcaccttacgagatccgcgattccttctgcatgaccgccggcgagaaggtcatggagctgatatcagccaacatccggccgcgcgacatcgtgacgcgagcagcactcgagaatgccgctgcggttgtggcggcctccggcggctcgaccaacgcggccctgcatctaccagcgattgcacacgaggccggcatcaagttcgacttattcgatgtcgccgaaatcttcaaaaagacaccttatatcgcggatttgaagccgggtggccgctatgtcgccaaagacatgttcgaggctggtggcattccgctcttgatgaagacgttgctcgaccatggctatttgaacggcgactgcctcacagtcaccggccggacgatcgccgaaaacctcaaaggcgtgaagtggaatccgcaccaggacgtggtgaggccggccgaccagccgatcactgcaaccggaggtgtcgttggtttgaaaggcaatctcgcgccagagggtgcgatcgtgaaagtcgcgggcatgtcgaacttgaaattcactgggccggcccgctgcttcgatcgggaagaggatgcctttgaagccgttcagaagcggtcctatcgcgagggcgaggtcatcgtcatccgctatgagggcccgcgcggcggtcccggcatgcgggaaatgctgcagaccacggcggcgctgacggggcagggcatgggcggcaagatcgcgctcatcaccgatggccggttctcgggcgcgacgcgcggcttctgcatcggccatatcgggccggaggcggcggtcggcggaccgatcgcgctggtcgaggatggcgacatcatcgagatcgacgccgaggcgggcatcctgaacgtcaagttgagcgatgccgaactgacacaacgcaagaccaagtggacgccgcgtgaaacgcatcacacgtcaggtgcactttggaaatatgcccagcaggtgggacccgccgtggcgggggccgtcacccacccaggtggtgcgcaagagaagtattgctatgcggacatctga

SEQ ID NO: 56 - protein, 574 aa, Bradyrhizobium sp.
MDAKTDIKRRLPSRHVTEGPERAPHRSYLYAMGLTTAQIHQPFVGVASCWNEAAPCNIALMRQAQAVKKGVAHAGGTPREFCTITVTDGIAMGHDGMRSSLPSREAIADSVELTIRGHAYDALVGLAGCDKSLPGMMMAMVRLNVPSIFIYGGSILPGNFRGQQVTVQDMFEAVGKHSVGAMSDEDLDELERVACPSAGACGAQFTANTMATVSEAIGLALPYSAGAPAPYEIRDSFCMTAGEKVMELISANIRPRDIVTRAALENAAAVVAASGGSTNAALHLPAIAHEAGIKFDLFDVAEIFKKTPYIADLKPGGRYVAKDMFEAGGIPLLMKTLLDHGYLNGDCLTVTGRTIAENLKGVKWNPHQDVVRPADQPITATGGVVGLKGNLAPEGAIVKVAGMSNLKFTGPARCFDREEDAFEAVQKRSYREGEVIVIRYEGPRGGPGMREMLQTTAALTGQGMGGKIALITDGRFSGATRGFCIGHIGPEAAVGGPIALVEDGDIIEIDAEAGILNVKLSDAELTQRKTKWTPRETHHTSGALWKYAQQVGPAVAGAVTHPGGAQEKYCYADI

SEQ ID NO: 57 - DNA, 1725 bp, Bradyrhizobium japonicum
atgaacgcaaagaccaacatcaagcagaggctgccgagccgtcacgtgacggaaggccctgcgcgcgcgccccatcgctcctacttctacgccatgggtctgacgacggagcagatccaccagcccttcgtcggcgtcgcctcctgctggaacgaggccgcgccctgcaacatcgctttgatgcgccaggcgcaggcggtgaagaagggcgtcgcgcatgccggcggcacaccccgcgaattctgcaccatcaccgtgaccgacggcatcgccatgggccatgacggcatgcgctcctcgctgccgtcgcgcgaatgcatcgccgattccgtcgagctgaccgtccgcggccatgcctatgacgccctcgtcggccttgccggctgcgacaagtcgctgccgggcatgatgatggcgatggttcgcctcaacgtgccctcgatcttcatctatggcggctcgatcctgcccggcaacttccgcgggcagcaggtcaccgtgcaggacatgttcgaggccgtcggcaagcactcggtcggcgccatgtcggacgaggatctcgacgagatcgagcgcgtggcgtgcccctcggcgggtgcctgcggcgcgcagttcacggccaacaccatggcgaccgtctcggaagccatcggccttgcgctgccttactcggccggtgctccggcaccgtatgaaatccgcgacgccttctgcatgaccgcgggcgagaaggtgatggagctgatcgaccagaacatccggccgcgcgacatcgtcacccgcaaggcgctggagaatgcggccgccgtggtcgcggcctccggcggctcgaccaatgctgcgctgcacctgccggcgatcgcgcacgagtgcggcatcaagtttgacttattcgacgtcgccgaaatcttcaaaaagacaccatatgtcgcggatttgaagccgggcggccgttatgtcgccaaagacatgtttgaagtaggtggcatcccgcttctgatgaagacgctgctcgacaacggatttctccacggcgactgcattacggtcaccggtcgaacgatcgccgaaaacctcaagagcgtgaagtggaatccgcaccaggatgtggtgcacccggcagacaagccgatcaccgtcaccggtggtgtggtgggtctgaagggcaatttggcgccagaaggtgcgatcgtgaaagtcgcgggaatgtccaacctgaggtttaccggtccggcacgctgcttcgaccgggaagaggacgccttcgaggccgtccagaaccgcacataccgcgaaggcgaagtcatcgtgatccgctacgagggccccaagggcggccccggcatgcgggaaatgctccagaccaccgcggcgctgaccgggcagggcatgggcggcaagatcgcgctcatcactgacggccgcttctccggcgccacccgcggcttctgcatcggccatgtcgggccggaagccgccatcggcggcccgatcgggctgctcgaggatggcgacatcatcgagatcgacgcggtcgccggcacccttaacgtaaaattgagcgaccaggagcttgcccagcgcaagaccaaatggagcgctcgcgcgactaaccacacgacgggcgcgctctggaaatatgctcagcaggttggaccagcggtcgggggggcggtcacccatccgggcggtgcgcacgagaaacagtgctatgcggacatctag

SEQ ID NO: 58 - protein, 574 aa, Bradyrhizobium japonicum
MNAKTNIKQRLPSRHVTEGPARAPHRSYFYAMGLTTEQIHQPFVGVASCWNEAAPCNIALMRQAQAVKKGVAHAGGTPREFCTITVTDGIAMGHDGMRSSLPSRECIADSVELTVRGHAYDALVGLAGCDKSLPGMMMAMVRLNVPSIFIYGGSILPGNFRGQQVTVQDMFEAVGKHSVGAMSDEDLDEIERVACPSAGACGAQFTANTMATVSEAIGLALPYSAGAPAPYEIRDAFCMTAGEKVMELIDQNIRPRDIVTRKALENAAAVVAASGGSTNAALHLPAIAHECGIKFDLFDVAEIFKKTPYVADLKPGGRYVAKDMFEVGGIPLLMKTLLDNGFLHGDCITVTGRTIAENLKSVKWNPHQDVVHPADKPITVTGGVVGLKGNLAPEGAIVKVAGMSNLRFTGPARCFDREEDAFEAVQNRTYREGEVIVIRYEGPKGGPGMREMLQTTAALTGQGMGGKIALITDGRFSGATRGFCIGHVGPEAAIGGPIGLLEDGDIIEIDAVAGTLNVKLSDQELAQRKTKWSARATNHTTGALWKYAQQVGPAVGGAVTHPGGAHEKQCYADI

SEQ ID NO: 59 - DNA, 1725 bp, Fulvimarina pelagi
atggacgcacgcgtgatcgacaagacgaaacttccgagccgtcatgtgacggaaggaccgacccgcgcgccgcaccgctcgtatctctatgcgatgggtctctccaaggaagagatccatcagccactggtcggtgttgcctcctgctggaacgaggccgcaccctgcaatatctcgctgatgcgtcaggcgcaggtcgtaaaaaagggcgttgctgccgcacacggaacgccgcgcgaattctgcacgattaccgtcaccgacggtattgccatgggccatcagggcatgaagtcgtcgctggtctcgcgcgatctcatcgccgactcggtcgaactcaccatgcgaggccactcctacgacgcgcttgtcggtcttgccggctgcgacaagtcgctgccaggcatgatgatgtcgatggtacgcctcaacgttccctcggtcttcatctacggtggctcgattctgcccggcaccttcaagggccggcaggtgaccgtgcaggatattttcgaggcggttggccagcattccgtcggcgagatgtcggacgaggatctcgacctgatcgaacaggttgcctgcccctccgccggttcctgcggcgcccagttcacagcgaacaccatggcgacggtcgcagaggcgatcggccttgcgctgccatactcctgcggtgcgccggcgccttacgaaatccgcgaccgcttctgctacgcctcgggcgagatcgtgatggatcttctgcgccgtaacatccgtccgcgcgacatcgtcacccgcaagtcgctggagaatgcggcggccgtcgtcgcggccacgggcggctcgaccaatggcgcgctgcatctgccggcgatcgcccatgagtgtggcatcgagttcgatctcttcgacgtcgccgagatcttccgcaagacgccctacgtcgcggacctcaaaccgggtggcaaatacgtcgccaaggacatgttcgaggccggcggcattccgctcctgatgaagaccatgctggagcacggctatctccacggcgactgcatgacggtcaccggacgcacgatggccgagaacatggagaaggtcgcctggaacgcggatcaggatgtggttcgcccagccaacaatccgatcacgaagaccggcggtgttgtcggcctgaagggcaatctcgcttccgacggtgcgatcgtgaaggtcgcgggcatgaagaacctgaaattctcagggccagcgcgctgtttcgattcggaggaggattgtttcaaagcggtttcggctcgcgactataaggagggcgaggttctcgtcattcgctacgagggtccgaaaggtggccccggcatgcgcgagatgcttcagacgaccgctgcgatctacggccagggaatgggcgacaaggtcgccctcatcactgatggccgcttttccggcgccacccgcggcttctgcatcggccatgttggcccggaagcggcggtcggcggaccgatcggccttttgaaagacggcgacgtgattacgatcgacgcagtcgagggaacgctggacgttgcattgagcgaagatgaactcgccgagcgccgcaaggcttgggagccgcgcgaaaccgactatcagtcgggcgcgctctggaagtatgcccaggtggttggcacggcccgtctcggtgccgtcacccatcccggcggtgcagccgagaggcagtgctatgcggacatctaa

SEQ ID NO: 60 - protein, 574 aa, Fulvimarina pelagi
MDARVIDKTKLPSRHVTEGPTRAPHRSYLYAMGLSKEEIHQPLVGVASCWNEAAPCNISLMRQAQVVKKGVAAAHGTPREFCTITVTDGIAMGHQGMKSSLVSRDLIADSVELTMRGHSYDALVGLAGCDKSLPGMMMSMVRLNVPSVFIYGGSILPGTFKGRQVTVQDIFEAVGQHSVGEMSDEDLDLIEQVACPSAGSCGAQFTANTMATVAEAIGLALPYSCGAPAPYEIRDRFCYASGEIVMDLLRRNIRPRDIVTRKSLENAAAVVAATGGSTNGALHLPAIAHECGIEFDLFDVAEIFRKTPYVADLKPGGKYVAKDMFEAGGIPLLMKTMLEHGYLHGDCMTVTGRTMAENMEKVAWNADQDVVRPANNPITKTGGVVGLKGNLASDGAIVKVAGMKNLKFSGPARCFDSEEDCFKAVSARDYKEGEVLVIRYEGPKGGPGMREMLQTTAAIYGQGMGDKVALITDGRFSGATRGFCIGHVGPEAAVGGPIGLLKDGDVITIDAVEGTLDVALSEDELAERRKAWEPRETDYQSGALWKYAQVVGTARLGAVTHPGGAAERQCYADI

SEQ ID NO: 61 - DNA, 1815 bp, Aurantimonas sp.
ttgccgccacaaaacccgctcaccccagaggtgctgatcgggcgcggcgtcgaggcgggccatgaacagcgttgtgtacgagggggaccgatggacgcgcattcgatcgacaagaagaacctgcccagccggcatgtgaccgaggggccgtcgcgcgcgccgcaccgctcgtacctctacgccatgggtctcaccaaggaagagatccatcagccgctggtcggcgtcgcctcctgctggaacgaggccgcgccgtgcaacatctcgctgatgcgccaggcgcaggtcgtcaagaagggcgtcgcggcagcccgcggtacgccgcgcgagttctgcaccatcaccgtcaccgacggcatcgccatgggccatcagggcatgaaggcttcgctcgtctcgcgcgacctcatcgccgattcggtcgaactgaccatgcgcggccacgcctatgacgcgctggtgggtctggcaggttgcgacaagtcgcttccgggcatgatgatggcgatggttcgcctgaacgtgccgtcggtcttcatctatggcgggtcgatcctgccgggcaatttccgcggccagcaggtcaccgttcaggacatcttcgaggcggtcggcaagcattcggtcggcgagatgaacgacgccgatctcgacgagatcgagcaggtcgcctgtccgtcagccggttcctgcggcgcgcagttcaccgccaacaccatggcgaccgtcgccgaggccattggcctggcgctgccctattcctgcggtgcgccggcgccctacgagatccgcgacaagttctgctacgcctcgggcgagatcgtcatggaactcttggcccgcaacatccggccgcgcgacatcgtcacccgcaaggcgttggagaacgccgccgccgtcgtcgcggcgaccggcggatcgaccaatggcgccctgcacctgccggcgatcgcgcatgagtgcggcatcgagttcgacctgttcgacgtcgcggagatcttccgcaagacgccgtacatcgccaacctcaagccgggcggcaaatacgtcgccaaggacatgttcgaggccggcggcatcccgatgctgatgaagaccatgctggaccatggctatctgcacggcgactgcatgaccgtcaccggccgcaccattgccgagaacatggcgaaggtgacctggaacccgaaccaggacgtcatccatccggccaacacgccgatcacccagaccggcggcgtcgtcggcctgaagggtaacctcgcccaggacggcgccatcgtgaaggtcgcgggcatgaagaacctgcggttctccggcccggcgcgctgcttcgattcggaagaggaatgctacgaggccgtctccaagcgccagtacaaggaaggcgaggttctcgtcatccgctacgagggcccgcgcggcggacccggcatgcgcgagatgctgtcgaccacggcggcgctctacggccagggcatgggcgacaaggtcgcgctgatcaccgacggccggttctccggcgcgacccgcggcttctgcatcggccatgtcggtccggaagcggcgctcggcggtccgatcggcctgctgcgcgacggtgacatcatcaccatcgatgccgtcgccgggacactggacgtggacgtctcggatgacgacatgaagaagcgggccgaagactggaagccccgcgaaaccgactaccagtccggtgccatctggaaatacgcccagcaggtcggcacggcgcgcctcggcgcagtgacacatccgggcgcagcggcggaaaagcactgttatgcggacctctag

SEQ ID NO: 62 - protein, 604 aa, Aurantimonas sp.
MPPQNPLTPEVLIGRGVEAGHEQRCVRGGPMDAHSIDKKNLPSRHVTEGPSRAPHRSYLYAMGLTKEEIHQPLVGVASCWNEAAPCNISLMRQAQVVKKGVAAARGTPREFCTITVTDGIAMGHQGMKASLVSRDLIADSVELTMRGHAYDALVGLAGCDKSLPGMMMAMVRLNVPSVFIYGGSILPGNFRGQQVTVQDIFEAVGKHSVGEMNDADLDEIEQVACPSAGSCGAQFTANTMATVAEAIGLALPYSCGAPAPYEIRDKFCYASGEIVMELLARNIRPRDIVTRKALENAAAVVAATGGSTNGALHLPAIAHECGIEFDLFDVAEIFRKTPYIANLKPGGKYVAKDMFEAGGIPMLMKTMLDHGYLHGDCMTVTGRTIAENMAKVTWNPNQDVIHPANTPITQTGGVVGLKGNLAQDGAIVKVAGMKNLRFSGPARCFDSEEECYEAVSKRQYKEGEVLVIRYEGPRGGPGMREMLSTTAALYGQGMGDKVALITDGRFSGATRGFCIGHVGPEAALGGPIGLLRDGDIITIDAVAGTLDVDVSDDDMKKRAEDWKPRETDYQSGAIWKYAQQVGTARLGAVTHPGAAAEKHCYADL

SEQ ID NO: 63 - DNA, 1725 bp, Hoeflea phototrophica
atgagcgtcaaagcattcgacaagtccaagcttccaagccgctacacaacggtcggcccggcgcgggcgccgcacagatcgttcctgtatgctatggggctttcgagcgaggagattgctcagccgctcgttggcgtggcgtcgtgctggaatgaggccgcaccctgcaacatttcgctgatgcgccaggcgcaggtggtgaagaaaggcgtggcttcggcccacggcacaccgcgcgaattctgcaccatcacagtgactgatggcattgcgatgggtcaccagggcatgaaagcttccctggcgagccgcgatctgattgcagattcggtggaattgaccatgcgcggtcactgctacgatgcgatcgtgggtcttgccgggtgcgacaagtcattgccgggcatgatgatgtcgatggtgcgtctgaacgtgccctcgatcttcatctatggcggttctattttgccaggcagcttccgcggccgccagattaccattcaggacgtgttcgaggccgtggggcagcattcggttggcgatatgtcggatgaagacctgctcgaaatcgagcaggttgcctgtccgtcggcgggttcctgcggcgcgcagttcacagccaacacgatggcgactgttgccgaggcgatcggactggcgctgccctattcatgtggcgcgccggcgccttacgagatccgcgaccggttcgcttacgcggccggtgaaaaagtgatggaattgctggccaagcagatccgtccgcgcgacatcgtgacccgcaaggcgctcgaaaacgccgcggccgtcgtcgcggcttcgggcggttcgaccaacgcggcgctgcatctgccagcgattgcgcatgaatgcgggatcgagttcgatctgtttgacgtggctgagatcttcaagaagacgccctacattgccgacctcaagcccggcggcaaatatgtggccaaggacatgttcgaggctggtggcattccgctgttgatgaagaccatgcttgaacatggctatctgcacggcgattgcatgaccgtgacgggccggaccatcgccgagaacatggagaaggtctcctggaacccggagcaggatgtggtgcgcccggcggataagccgatcaccgcgaccggcggtgtggtgggcctcaagggcaatcttgcgaccgacggggcgatcgtgaaagttgccgggatggaacggctgaaattcaccggacccgcacggtgttttgattccgaggaagagtgcttcaatgcggtcacaaatcgcgactataacgaaggcgacgttcttgtgatccgctacgaggggcccaagggcggccccggtatgcgtgagatgctgtcgaccactgcggccatttatggacagggtatgggcgacaaggtggcattgatcacggatggccggttctccggtgcaacgcgcggcttctgcattggccatgtcggcccggaagcggcggaaggcgggccgatcgggctcctggaagatggcgacatcatcgagatcgatgctgttgatggtgttttgagcgtgcagctttccgatgcggaactggctgcgcgcagggaaaagtggacggcgcgcgaaaccgattatgcatcgggcgtgctgtggaaatatgcccagacggtgggggccgcgcgttacggcgccgttacccatccgggcggagcaaaagaaaagcagtgctatgcggatatctga

SEQ ID NO: 64 - protein, 574 aa, Hoeflea phototrophica
MSVKAFDKSKLPSRYTTVGPARAPHRSFLYAMGLSSEEIAQPLVGVASCWNEAAPCNISLMRQAQVVKKGVASAHGTPREFCTITVTDGIAMGHQGMKASLASRDLIADSVELTMRGHCYDAIVGLAGCDKSLPGMMMSMVRLNVPSIFIYGGSILPGSFRGRQITIQDVFEAVGQHSVGDMSDEDLLEIEQVACPSAGSCGAQFTANTMATVAEAIGLALPYSCGAPAPYEIRDRFAYAAGEKVMELLAKQIRPRDIVTRKALENAAAVVAASGGSTNAALHLPAIAHECGIEFDLFDVAEIFKKTPYIADLKPGGKYVAKDMFEAGGIPLLMKTMLEHGYLHGDCMTVTGRTIAENMEKVSWNPEQDVVRPADKPITATGGVVGLKGNLATDGAIVKVAGMERLKFTGPARCFDSEEECFNAVTNRDYNEGDVLVIRYEGPKGGPGMREMLSTTAAIYGQGMGDKVALITDGRFSGATRGFCIGHVGPEAAEGGPIGLLEDGDIIEIDAVDGVLSVQLSDAELAARREKWTARETDYASGVLWKYAQTVGAARYGAVTHPGGAKEKQCYADI

SEQ ID NO: 65 - DNA, 1761 bp, Mesorhizobium loti
atgcggcaggccgcaccgcccgcggcaaggatgagaatggacgccaaggtcatttcaaaggctaagctccctagccgccatgtgactgtcggtccggcgcgtgcgccgcaccggtcctatctctatgccatggggctttccgccgccgagatcgcgcagccgctggtcggcgtcgcctcctgctggaacgaagccgcgccctgcaacatctcgctgatgcgccaggcgcaggtggtcaagaagggtgtcgccgccgccaacggcacaccgcgcgaattctgcaccatcaccgtcaccgacggcatcgccatgggccaccagggcatgaagtcgtcgctggtgtcgcgcgaggtcatcgccgattcggtcgagctcacgatgcgtggccattgctacgatgcgctggtcggcctcgccggctgcgacaagtcgctgcccggcatgatgatggccatggtgcggctcaacgtgccgtcgatcttcatctatggcggttcgatcctgcccggcagctatcgcggccgtcagattaccgtgcaggacgtgttcgaggcggtcggccagcactccgtcggcacgatcggcgacgccgagctgctcgagatcgagcaggcggcctgtccgtcggccggctcctgcggcgcccagttcaccgccaacaccatggcaaccgtcgccgaggcgatcggtctggcgctgccctattcctgcggcgcgccggcgccttacgaaatgcgcgaccgcttcaatttcgcctccggcgaaaagatcatggagctgatcgccaaaaacatccggccgcgcgacatcatcacgctgaaggcgctggagaacgcggcgaccgtggtttccgccaccggcggttcgaccaatgcggcgctgcatctgccggcgatcgcgcatgaggcgggcatcaaattcgatctcttcgatgtcgcaaggattttcgagaagacgccctacatcgccgacctcaagcctggcggcaaatatgtcgcaaaggacatgttcgaggccggcggcattccgctgttgatgaagacgctgctcgaccacggctatctgcatggcgattgcctgacggtgactggccgcactttggccgaaaacatggagcacgttgcctggaatgaacaccaggatgtggtccgcccggccaacagaccaattacccaaaccggcggtgtcgtgggcttgaagggaaaccttgcccccgaaggcgcgatcgtgaaagtcgcgggcatgacggagttgaaattctccggcccggcgcgctgcttcgattcggaagaggaatgtttcgaggcggtgacgcaacgcaactacagggaaggcgaggttctcgtcattcgctacgaagggccgcgcggtggtcccggcatgcgcgagatgctgtcgacgacggcagcgctctacggccagggcatgggcggcaaggtggcgctgatcaccgacggccgcttctcgggcgcgacgcgcggcttctgcatcggccatgtcgggccggaagcggcggtgggcggcccgatcggcctcatccgggatggcgacgtgatttcgatcgacgccgtgaacggcacgatcgaagtggcgctgtcggatagcgaactggcggcgcgggccaagacatggaaggcgcgcacgaccgactatcagtcgggcgcgatatggaaatacgcacagacggtcgggtctgccagggatggcgcggtcacccatccgggtggtgcgaaagaaacacactgctatgcggatatctga

SEQ ID NO: 66 - protein, 586 aa, Mesorhizobium loti
MRQAAPPAARMRMDAKVISKAKLPSRHVTVGPARAPHRSYLYAMGLSAAEIAQPLVGVASCWNEAAPCNISLMRQAQVVKKGVAAANGTPREFCTITVTDGIAMGHQGMKSSLVSREVIADSVELTMRGHCYDALVGLAGCDKSLPGMMMAMVRLNVPSIFIYGGSILPGSYRGRQITVQDVFEAVGQHSVGTIGDAELLEIEQAACPSAGSCGAQFTANTMATVAEAIGLALPYSCGAPAPYEMRDRFNFASGEKIMELIAKNIRPRDIITLKALENAATVVSATGGSTNAALHLPAIAHEAGIKFDLFDVARIFEKTPYIADLKPGGKYVAKDMFEAGGIPLLMKTLLDHGYLHGDCLTVTGRTLAENMEHVAWNEHQDVVRPANRPITQTGGVVGLKGNLAPEGAIVKVAGMTELKFSGPARCFDSEEECFEAVTQRNYREGEVLVIRYEGPRGGPGMREMLSTTAALYGQGMGGKVALITDGRFSGATRGFCIGHVGPEAAVGGPIGLIRDGDVISIDAVNGTIEVALSDSELAARAKTWKARTTDYQSGAIWKYAQTVGSARDGAVTHPGGAKETHCYADI

SEQ ID NO: 67 - DNA, 1728 bp, Mesorhizobium sp.
atgatggacgctcgtgcgatatcgaaggaaaagctgcccagccgctacgttaccgtagggccggcgcgggcgccgcacaggtcttatctttacgcgatggggctctcggcggaagagatcgctcagccgctggtcggcgtggcgacgtgctggaacgaggctgcgccctgcaacatctcgctgatgcgccaggcgcaagtggtgaaaaagggcgtcgcggcagccaaaggcacgccccgcgagttcacaacgattaccgttactgatggcatcgccatgggccaccagggcatgaaggcgtcgctggcctcgcgcgaggtaatcgcggattctgtggaactcaccatgcgcggccattgctatgacgcgcttgtcggccttgcgggttgtgacaaatccctgccggggatgatgatggccatggtgcgcctcaatgtgccgtcggtcttcatctatggcggttcgatcctgcctggcacctggcgcgggcggcagatcaccgttcaagacgttttcgaggcggtcggccagcattcggttggctccatttccgacgacgagctgatggaaatcgagcaagccgcttgtccctcggccggttcctgcggcgctcaattcacggccaacaccatggcgaccgttgccgaggcgattgggctggcgcttccttattcctgcggtgcgcctgcgccttacgagatgcgcgatcgcttcaactatgccgccggcgagaaggtgatggaactggtggccaagcagatacggccgcgtgacatcgtgacccggaaggcgcttgaaaacgccgcggccgtggttgccgcgtcggggggctccaccaatgcggcattgcatttgccggccatcgctcatgaagccggaattgaattcgaccttttcgacgtcgcggaagtgttcaagagaacaccctatgtcgccgatttgaagccgggcggcaaatatgtcgccaaggacatgttcgaggcgggcggcattccgctgctcatgaagaccttgctcgaccatggctatctgcatggcgactgcatgaccgtcaccggccgcacgcttgcggagaacatggaacgcgtcgagtggaacgatgcgcaggacgtggtttatccggctgacaagccgctgagcccgacgggcggcgtcgtgggccttaaaggcaatctcgcgccggatggggcaatcgtgaaggttgcaggcatgaagaacctgcgcttctccggccccgcgcgctgcttcgattcggaagaggaatgcttcgccgcggtttccgagcgccgctataaggaaggcgaggtgctggtgatccgctacgaaggtccgaaaggcgggccgggcatgcgtgaaatgctcgccaccaccgcggccctttacgggcagggcatgggcgacaaggtggcgctgatcacggacgggcggttttcaggcgcgacccgcggcttctgtatcggtcatgtcgggccggaagcagcagtgggcgggccgatagggcttctcaatgacggcgacatcataaccatcgatgcggtggcaggcacgatcgacgtggcgctcggcgaagcggaactggccgaacgccgcgctgcctggaggccgcgcgaaagcgaatatcggtccggcgcgatctggaaatacgcgcagggcgtgggcccggcgcggtatggcgcggtgacgcatcccggcgcccagaaagaaacgcactgctatgcggatatctga

SEQ ID NO: 68 - protein, 575 aa, Mesorhizobium sp.
MMDARAISKEKLPSRYVTVGPARAPHRSYLYAMGLSAEEIAQPLVGVATCWNEAAPCNISLMRQAQVVKKGVAAAKGTPREFTTITVTDGIAMGHQGMKASLASREVIADSVELTMRGHCYDALVGLAGCDKSLPGMMMAMVRLNVPSVFIYGGSILPGTWRGRQITVQDVFEAVGQHSVGSISDDELMEIEQAACPSAGSCGAQFTANTMATVAEAIGLALPYSCGAPAPYEMRDRFNYAAGEKVMELVAKQIRPRDIVTRKALENAAAVVAASGGSTNAALHLPAIAHEAGIEFDLFDVAEVFKRTPYVADLKPGGKYVAKDMFEAGGIPLLMKTLLDHGYLHGDCMTVTGRTLAENMERVEWNDAQDVVYPADKPLSPTGGVVGLKGNLAPDGAIVKVAGMKNLRFSGPARCFDSEEECFAAVSERRYKEGEVLVIRYEGPKGGPGMREMLATTAALYGQGMGDKVALITDGRFSGATRGFCIGHVGPEAAVGGPIGLLNDGDIITIDAVAGTIDVALGEAELAERRAAWRPRESEYRSGAIWKYAQGVGPARYGAVTHPGAQKETHCYADI

SEQ ID NO: 69 - DNA, 1731 bp, Parvibaculum lavamentivorans
atggacgccaagacattcgacaaatcgaaactgccgagccgccacgtcacggtcgggccggagcgcgcgccgcaccggtcctactactatgcgatgggcctcaccgaggaagagatcaatcagcccttcgtcggcgtggcgacctgctggaacgaggcggctccctgcaacatcgcgttgatgcgtcaggcgcagtcggtgaagaagggtgtcaaggccgccgccggcacgccccgcgaattctgcaccatcacggtgacggacggcatcgccatgggccaccagggcatgaaatcctcgctcgccagccgcgacgtgatcgcggattcggtcgagctcaccatgcgcggtcattgctacgacgcgctggtcggccttgccggctgcgacaagtcgctgccgggcatgatgatgtcgatggttcgtctcaacgtcccctccgtcttcatgtatggcggctcgatcctgccgggccatttcaagggcaaggacgtcaccgtggtcgacgtcttcgaggcggtcggccagcactcggcgggcaacatggaagacgaagagctgcatgcgctcgaatgcgtcgcctgtccctccgccggcgcctgcggcggccagttcacggccaacaccatggcctgcgtttcggaagccatgggcctcgcgctgccgggttcggcgggcgcgcctgcgccttatgagagccgcgacgaatatgcggaagcctcgggccgcgccgtcatgcacctcctcgccaacaacatccggccgcgcgacatcgtcacgcgcaaggcgctcgagaatgccgccgtcatcgtcgcggcgacgggcggttcgaccaatggcgggcttcatctcccggccatcgcgcatgaagcgggcatcgatttcgacctgatggaagtcgccgaaatcttcaagaagacgccctacatcaccgacctgaagcccggcggcaattacgtcgcgaaggatcttcacgaggcgggcggcgtttcgatggtcctcaaggtgctgctcgatggcggctatctccacggcgattgcctcaccgtcaccggccagtcgctcgcagacaacctcaaggacgtgaagttcaacccggaccagaaggtcgtctatccgctgtccaatccgctctcgcccaccggcggcgttgtcgggttgcagggctcgctcgcgccggatggcgccatcgtcaaggtcgcgggcatggagaaggatcatctccgtttctccggtccggcgcgttgcttcgacagcgaagaggaatgcttcgaggcggtcgacaaacgtcagtacaaggaaggtgaggttctcgtcatccgctacgagggaccgaagggtggccccggcatgcgcgaaatgctctccaccaccgccgcgctttacggccagggcatgggcgacaaggtcgcgctcatcaccgatggccgcttctccggcggcacgcgcggtttctgcatcggccatgtcggcccggaagccgccgtcggcggccccatcgcgctgatcgaggatggcgacatcatcaccatcgacgcggagaacggcaccatcgatctcgaagtcgacgaagccgtgctcgaaaagcgccgcgcgaactggaagccccgggagaccatgtacgcctccggcgcgctgtggaaatacgcgcagctcgtcggcaccgcccgcaagggcgccgtcacccatccgggcggcaaggcggagaaacatgtctatgcggatatctga

SEQ ID NO: 70 - protein, 576 aa, Parvibaculum lavamentivorans
MDAKTFDKSKLPSRHVTVGPERAPHRSYYYAMGLTEEEINQPFVGVATCWNEAAPCNIALMRQAQSVKKGVKAAAGTPREFCTITVTDGIAMGHQGMKSSLASRDVIADSVELTMRGHCYDALVGLAGCDKSLPGMMMSMVRLNVPSVFMYGGSILPGHFKGKDVTVVDVFEAVGQHSAGNMEDEELHALECVACPSAGACGGQFTANTMACVSEAMGLALPGSAGAPAPYESRDEYAEASGRAVMHLLANNIRPRDIVTRKALENAAVIVAATGGSTNGGLHLPAIAHEAGIDFDLMEVAEIFKKTPYITDLKPGGNYVAKDLHEAGGVSMVLKVLLDGGYLHGDCLTVTGQSLADNLKDVKFNPDQKVVYPLSNPLSPTGGVVGLQGSLAPDGAIVKVAGMEKDHLRFSGPARCFDSEEECFEAVDKRQYKEGEVLVIRYEGPKGGPGMREMLSTTAALYGQGMGDKVALITDGRFSGGTRGFCIGHVGPEAAVGGPIALIEDGDIITIDAENGTIDLEVDEAVLEKRRANWKPRETMYASGALWKYAQLVGTARKGAVTHPGGKAEKHVYADI

SEQ ID NO: 71 - DNA, 1734 bp, Loktanella vestfoldensis
atgcccagcaaccgtgtcgacaaatccaaattgcccagccgccacgtgactgaaggcccgtctcgcgcgccgcaccggtcctatttttatgcgatgggcctggacgaacatgagatcgcacagccttgggtcggtgtcgccacctgctggaacgaagcagccccctgcaacatcacgctgaaccggcaggcccaagccgtcaaggtcggcgtcaagaacgccaaaggcacgccgcgcgaatttaccacaatcaccgtcaccgatggcatcgccatgggccatgaagggatgcggtcgtcactcgcatcacgcgaagcgattgccgataccgttgaactgacgatgcgcggccattgctatgacgcgctggtcggtctggccggttgcgacaaatccttgcccgggatgatgatggcgatggtgcggctgaacgtgccgtcggtgttcatctatggcggctcaatcctgccgggccggttaaacgggcaggacgtgaccgtccaagacgtgttcgaagcggtgggcaagcatcaggccggtaatatgaccgatgcggagctcgaaatccttgaacgcgtcgcctgcccctctgctggggcttgtggtggacaattcaccgccaacaccatggcctgcgtgtccgaagcaatcggtctggcgctgctcaattcctctggcgcgcctgcgccctacgaatcgcgcgatcaatatggtgtcgcttcgggcgaggccgtgatgaacctgatcgccaagaacatccgcgcgcgcgatatcgtcacgcgcaaatcactggaaaacgcggcacggatcgtggcctgcaccggcgggtccaccaatgccggtctgcacctgcctgcgatcgccgccgaggctggcattgattttgatctgtccgatgtctgcgagattttccgcgatacgccctatttcgtcgatctcaaaccgggcggcaaatatgtggccaaggatctttacgaggcaggcggcgtgcctgtcgtgctgaaagaactgcgcaaggccggtctgatccacgaagattgcatgacagcgacaggccgcgtgatcggtgaagaactggacatgatcaagggtgaggcggataaccgcgtcatctattccgtcgccaatccgatcacgaaaaccggcggtgttgtcggcctgaaaggcaaccttgcccccgaaggcgccatcgtcaaggtcgcgggcatgtccgaggaagaacagatatttaccggccctgcccgcgtgttcgaatgcgaagaagacgcgttcgaggccgtaaaagcccgccaatatgaagaaggcgaagtcatcgttatccgcaacgaaggccctgcaggcggccccggtatgcgcgaaatgctgtccaccaccgccgctttgtcgggccaaggcatgggcaaaaaggtcgcgctgatcaccgacggccgcttttcaggtgcgacacgcgggttctgcgtgggtcacgtcggcccagaggccgcgcagggcggccccatcgcgctgttgaaagacggcgacatgatcacgctgaacgcgcgcaccggcgaattgtcggtggcgctgaccgatgcagaactggccgaacggcgcaaaacctgggctggcccgcgcgaaactatctatgcctcgggagccttgtggaaatatgcacagctggtcggatcgacccgtctgggcgcattgacccatccaggtgccaagggcgaaaaacacatctatatggacctgtaa

SEQ ID NO: 72 - protein, 577 aa, Loktanella vestfoldensis
MPSNRVDKSKLPSRHVTEGPSRAPHRSYFYAMGLDEHEIAQPWVGVATCWNEAAPCNITLNRQAQAVKVGVKNAKGTPREFTTITVTDGIAMGHEGMRSSLASREAIADTVELTMRGHCYDALVGLAGCDKSLPGMMMAMVRLNVPSVFIYGGSILPGRLNGQDVTVQDVFEAVGKHQAGNMTDAELEILERVACPSAGACGGQFTANTMACVSEAIGLALLNSSGAPAPYESRDQYGVASGEAVMNLIAKNIRARDIVTRKSLENAARIVACTGGSTNAGLHLPAIAAEAGIDFDLSDVCEIFRDTPYFVDLKPGGKYVAKDLYEAGGVPVVLKELRKAGLIHEDCMTATGRVIGEELDMIKGEADNRVIYSVANPITKTGGVVGLKGNLAPEGAIVKVAGMSEEEQIFTGPARVFECEEDAFEAVKARQYEEGEVIVIRNEGPAGGPGMREMLSTTAALSGQGMGKKVALITDGRFSGATRGFCVGHVGPEAAQGGPIALLKDGDMITLNARTGELSVALTDAELAERRKTWAGPRETIYASGALWKYAQLVGSTRLGALTHPGAKGEKHIYMDL

SEQ ID NO: 73 - DNA, 1734 bp, Roseobacter sp.
atgcccaaagatcaggtcaataagacacacctgcccagccgccatgtgaccgaaggcccatcgcgcgcgccgcaccggtcgtatttttacgccatgggtctggatgaagaagcgatcaagcaaccttgggttggtgtcgcgacctgctggaacgaagcggccccttgcaacatcgccctgaaccgtcaggcgcagtcggtcaagctgggtgtgaaaaaggcgatgggcacgccgcgcgaatttacaacgattactgtcaccgacggcattgcgatggggcatgaagggatgcgctcttcgctggcgtcacgcgaagcaattaccgatacggttgagctgacgatgcgcggccactgctatgatgcgctggtcggtctggccggttgcgacaaatccctgcccggtatgatgatggcgatggtccgtctgaacgtgccgtccgtctttatctatggcgggtccattctgccgggtcgtctggatggcaaggacgtgactgttcaggacgtgttcgaggctgtgggtaaacaccaagcgggcaatatgactgatgcggaactggaagtgctggaacgtgtagcgtgtccatctgctggcgcttgcggtggtcagtttacggccaatacgatggcttgtgtgtccgaagcgattggtctggccctgatgaattcttccggtgcccctgccccttatgaaagccgcgaccagtatggcattgcatcgggtgaagcggtcatgaacctgattgaaaagaacatccgcgcccgtgatgttgtcacccgcaagtcgcttgagaacgccgcgcgcgttgtggcctgtaccggtgggtccaccaatgccggtctacacctgccggccattgcgcatgaggctggcattgatttcgacctttttgatgtctgcgacatcttccgtgatacgccttattttgtcgatctgaaaccgggtggtcaatatgtggccaaagacctttacgaggctggcggcgtacccgtcgtgctgaaagaactgcgcaaggccggtctgatccacgaggagtgcatgacagcatcaggccggaccatgggcgaagagctggatatgatcaaaggcgaggcggacaataaggtgatctattctatcgaaaacccgctgacaccaaccggtggcgttgttggtttgaagggtaatcttgcccccgaaggtgcgattgtgaaggtcgcggggatgaatacgcaagaacagtcttttacaggtcccgcccgttgctttgaaagcgaagaagatgcgtttgaggctgtgaaagcccgccaatacgaagaaggcgaagtgctggtgatccgcaatgaaggccccgccggtggccccggtatgcgcgagatgctggcgacgactgccgcactgtccggccaaggcatgggcaaaaaggtcgcgctgatcacggatggccgcttttctggtgcgacacgcgggttctgtgtgggtcatgtggggccagaggccgcgcacggtggcccgataggcctgttgcagaacggcgatgtcatcacaatcaacgctgtcactggtgaactgtcagtcgatctgagtgacgaagaactggcgacgcgcaaggcgaattggaaaggcccgaaagagacgatctatgcatccggtgctttgtggaaatacgcgcaacttgtgggtggtgcgcgtttgggtgcggtgacgcatccgggtgcgaagtctgaaaaacacatttacatggacctctga

SEQ ID NO: 74 - protein, 577 aa, Roseobacter sp.
MPKDQVNKTHLPSRHVTEGPSRAPHRSYFYAMGLDEEAIKQPWVGVATCWNEAAPCNIALNRQAQSVKLGVKKAMGTPREFTTITVTDGIAMGHEGMRSSLASREAITDTVELTMRGHCYDALVGLAGCDKSLPGMMMAMVRLNVPSVFIYGGSILPGRLDGKDVTVQDVFEAVGKHQAGNMTDAELEVLERVACPSAGACGGQFTANTMACVSEAIGLALMNSSGAPAPYESRDQYGIASGEAVMNLIEKNIRARDVVTRKSLENAARVVACTGGSTNAGLHLPAIAHEAGIDFDLFDVCDIFRDTPYFVDLKPGGQYVAKDLYEAGGVPVVLKELRKAGLIHEECMTASGRTMGEELDMIKGEADNKVIYSIENPLTPTGGVVGLKGNLAPEGAIVKVAGMNTQEQSFTGPARCFESEEDAFEAVKARQYEEGEVLVIRNEGPAGGPGMREMLATTAALSGQGMGKKVALITDGRFSGATRGFCVGHVGPEAAHGGPIGLLQNGDVITINAVTGELSVDLSDEELATRKANWKGPKETIYASGALWKYAQLVGGARLGAVTHPGAKSEKHIYMDL

SEQ ID NO: 75 - DNA, 1734 bp, Dinoroseobacter shibae
atgctcaagcgttcgttcgacaagtccaagctgcccagccgtcacgtcaccgaaggcccttcgcgcgcgccgcatcggtcctattactatgccatgggcatgaccgaggaagagatccaccagccgctggtcggggtcgccacatgctggaacgaggccgcgccctgcaacatcgcgctcagccgccaggcccaggcggtgaagatgggggtcaagcaggcctccggcacgccacgagaattcaccacgatcaccgtgaccgacgggatcgccatgggccacgagggcatgcggtcctcgctggcctcccgcgaggcgattgccgatacggtcgaattgaccatgcgcggccattgctatgacgcgattgtgggtctggcgggctgcgacaagtccctgccggggatgatgatggccatggtgcggctcaacgtgccgtcggttttcatttatggcggctcgatcctgccgggtcggttgaacggcgaggacgtgacggttcaggacgtgttcgaggccgtgggcaagcaccaggccgggaactacaccgatgcagagctggaagtgctggagcgggtggcttgtccgtccgcaggggcctgtggcggtcagttcaccgccaataccatggcctgcgtgtccgaggcgatcggtctggcgctgccgaattccgcgggcgcacccgcgccctacgagagccgcgaccagtatggcgaggcgtcgggccgcgcggtcatggacctgatcgagaaaggcatccgcgcgcgggacatcgtgacccggaagtcgctggagaatgccgcgcggatcgtggcctgcaccggcgggtcgacgaatgccggtctgcacctgcctgcgattgcccatgaggccgggatcgaattcaccttgcaggatgtctgcgacatcttccgagacacgccctatttcgtggacctcaagccgggcggcaaatacgttgccaaggacatgtacgaagcgggcggcgtgcccgtggtgatgcgcgagctgcgccgcgcgggcctgatccacgaggattgcatgaccgtgaccggctattccatcggcgaggagctcgacaaggtcacgctcgaagccgatggccgggtgatctatccggtcgacacgccgctctcgaccacgggcggggttgtcggtctcgagggtaacctggcgcccgaaggtgccatcgtgaagatcgcgggcatgagcgacgaccagttggtcttcaccggcccggcgcgcgtgttcgaatgcgaagaggacgccttcgaggcggttcagaaccgcgcttacgcggaaggcgacgtcttcgtgatccgcaacgagggtcccgcaggcggtcccggcatgcgcgagatgctggccaccacggcggcgctctcgggtcagggcatgggcaagaaggtggcgctgatcaccgatggccggttctccggggccacgcgcggcttctgcgtcggccatgtgggccccgaagcggcccatggcggccccatcgcgatgctcaaggacggcgacatgatcaccatcgacgcgctgaagggcgagctgtccgtcgcgctgagcgaggatgagcttgccgcgcgaaaagatgcctggagcggcccgcgggagacgatctatgcctcgggtgcgttgtggaaatatgcgcagctggttggcggcgcacgcctgggggcagtcacccatcccggagccaaggatgaaaaacacatctacgccgatctctga

SEQ ID NO: 76 - protein, 577 aa, Dinoroseobacter shibae
MLKRSFDKSKLPSRHVTEGPSRAPHRSYYYAMGMTEEEIHQPLVGVATCWNEAAPCNIALSRQAQAVKMGVKQASGTPREFTTITVTDGIAMGHEGMRSSLASREAIADTVELTMRGHCYDAIVGLAGCDKSLPGMMMAMVRLNVPSVFIYGGSILPGRLNGEDVTVQDVFEAVGKHQAGNYTDAELEVLERVACPSAGACGGQFTANTMACVSEAIGLALPNSAGAPAPYESRDQYGEASGRAVMDLIEKGIRARDIVTRKSLENAARIVACTGGSTNAGLHLPAIAHEAGIEFTLQDVCDIFRDTPYFVDLKPGGKYVAKDMYEAGGVPVVMRELRRAGLIHEDCMTVTGYSIGEELDKVTLEADGRVIYPVDTPLSTTGGVVGLEGNLAPEGAIVKIAGMSDDQLVFTGPARVFECEEDAFEAVQNRAYAEGDVFVIRNEGPAGGPGMREMLATTAALSGQGMGKKVALITDGRFSGATRGFCVGHVGPEAAHGGPIAMLKDGDMITIDALKGELSVALSEDELAARKDAWSGPRETIYASGALWKYAQLVGGARLGAVTHPGAKDEKHIYADL

SEQ ID NO: 77 - DNA, 1728 bp, Roseovarius nubinhibens
atgaccaaattcgacaaagcaaaattgcccagccgccatgtgaccgaaggcccggcgcgtgcgccgcaccggtcctacatgtatgcgatggggcttcaggaagaagaaatccatcagcctctggtcggcgtggcgacctgctggaacgaggcggcgccgtgcaacatttcgctcaaccggcaggcgcaatcggtcaagatgggcgtcaaggaagcgggcggcacgccgcgcgagtttaccaccatcaccgtgaccgacggcatcgccatgggccatgagggcatgcgcagctcgctcgcgtcgcgcgaggcgattgccgacactgtcgagctcaccatgcgcggccattgctatgatgcgctcgtcggtctggcgggctgtgacaagtcgctgccggggatgatgatggcgatggtgcggctcaacacgccgtcggtcttcatctatggcggctcgatcatgccgggccggttccagggccgtgacgtgaccgtgcaggacgtgttcgaggccgtcggccgccatcaggcaggggccaattcggacgaagagctgcgggcgctggaaaaggtggcctgcccgtcggccggggcctgtggcggccagttcaccgccaacaccatggcctgtgtctctgaagcgatcggtctggcgctgcccaactcggcgggcgcgcccgcgccctatgaaagccgcgatcaatatggcaccgcctctggtgcggcggtcatgacgcttttggaaaagaacatccgggcgcgcgacatcgtcacgctcaagagccttgagaatgccgcgcgggtcgtggcctgtaccggtgggtcgaccaatgccggtctgcacctgcccgcgattgcgcatgaggcggggctcgagtttttcctcgatgacgtctgccagatcttcaaggacacgccctatttcgtcgatctcaaaccgggcgggcaatatgtcgccaaggacctctatgaggcgggcggcgtgccggtggtgatgaaggagctgcgcaaggcggggctcatccacgaagattgcatgaccgtcaccgggcggaccattggcgaagagatcgacatcgtcgagcgcgaggccgatggccgggtgatctatcccgtcgagaagccgatcaccaagaccggcggcgtcgtgggcctcaagggcaatcttgccccgcagggcgccatcgtgaaggtcgcgggtatgagcgaggaagagcaagtcttctcgggccccgcgcgggtttttgaatgcgaagaggacgcctttgaggcggtcaaggcgcgcagctacaaggagggcgaggttctcgtcatccgcaacgagggccccgcaggcggtccgggcatgcgcgagatgctcgccaccacggcggcgctgtcggggcagggcatgggcaagaaggtcgcgctcatcaccgatggccggttctcgggcgcgacgcgtggcttctgcgtcggccatgtcggaccggaatcggcccatggcggcccgattgccctggtccaggatggcgatgtgatcaccatcaacgcgatcaccggcgagctcagcgtggcgctcagcgatgaggatctgacggcccgcaaggaggcctggaaaggcccgcgcgagacgatctattccagcggcgcgctgtggaaatacgcccagctcgtgggcgagacctacaagggcgctgtgacccaccccggtgccgaagcggagaagcatgtctatatggatctctaa

SEQ ID NO: 78 - protein, 575 aa, Roseovarius nubinhibens
MTKFDKAKLPSRHVTEGPARAPHRSYMYAMGLQEEEIHQPLVGVATCWNEAAPCNISLNRQAQSVKMGVKEAGGTPREFTTITVTDGIAMGHEGMRSSLASREAIADTVELTMRGHCYDALVGLAGCDKSLPGMMMAMVRLNTPSVFIYGGSIMPGRFQGRDVTVQDVFEAVGRHQAGANSDEELRALEKVACPSAGACGGQFTANTMACVSEAIGLALPNSAGAPAPYESRDQYGTASGAAVMTLLEKNIRARDIVTLKSLENAARVVACTGGSTNAGLHLPAIAHEAGLEFFLDDVCQIFKDTPYFVDLKPGGQYVAKDLYEAGGVPVVMKELRKAGLIHEDCMTVTGRTIGEEIDIVEREADGRVIYPVEKPITKTGGVVGLKGNLAPQGAIVKVAGMSEEEQVFSGPARVFECEEDAFEAVKARSYKEGEVLVIRNEGPAGGPGMREMLATTAALSGQGMGKKVALITDGRFSGATRGFCVGHVGPESAHGGPIALVQDGDVITINAITGELSVALSDEDLTARKEAWKGPRETIYSSGALWKYAQLVGETYKGAVTHPGAEAEKHVYMDL

SEQ ID NO: 79 - DNA, 1734 bp, Sagittula stellata
gtgctcaagcgtccgtttgacaagaccaaactgcccagccgtcacgtcactgagggtcccgcccgcgcgccgcatcgctccttcatgtacgccatggggttgagcgaagaagagatccatcagcctcttatcggtgtcgcgacctgctggaacgaggccgcgccctgcaacatctcgctgagccggcaggcgcaggcggtgaagctgggtgtcaaggaagcctccggcacgccgcgcgaattcaccaccatcaccgtgaccgacggcatcgcgatgggccacgaggggatgcgtgcttcgctggcctctcgcgaagccatcgccgatacggtcgagctgacgatgcgcggccactgctacgacgcgcttgtggggcttgcgggctgcgacaagtcactgcccgggatgatgatggcaatggtgcggctcaatgtgccgtcggtcttcatctatggcgggtcgatcatgccgggcaagttccagggccgcgacatcaccgttcaggacgtgttcgaggccgtgggcaagcaccaggcgggcgccaactccgacgaggaactgcgcgccatcgagaaggcggcctgtccctcggccggggcctgcggcggccagttcaccgccaacaccatggcctgcgtgtccgaggccatcggccttgcgttgttgaattcttccggcgcgccagcgccttacgaaagccgcgaccagtacggcaccgcgtccggcatcgccgtgatgaacctgctggagcgcaacatccgcgcccgcgacatcgtcacgatgaagtctctggaaaacgcggcgcgggtggtcgcctgcaccggcggttcgaccaacgccggtctgcacctgcccgccatcgcacatgaggcagggctggaattcttcctagacgacgtgtgcgagatcttccgcgacacaccctatttcgtcgacctgaagcccggcggcaactatgtggccaaggacctttacgaggtcggtggcgttccggttgtgatgaaggagctgcgcgaggcgggcctgatccacgaggactgcatcaccgcatcggggcgatcaatgggagaggaactcgacctgatcgagcgcgaggccgatggcaaagtcatctatcccatagaaacgccgatcaccaagaccggcggcgtcgtgggcctgaagggcaacctcgccccgcagggcgccatcgtgaaggtcgcgggaatcgcggcggaggaccaggtgttcaccggtcccgcgcgtgtcttcgaatgcgaggaagactgctttgaagcggtcaagatgcgcgcctacaaggagggcgaggtgctggtcatccgcaacgagggccccgcaggcggccccggcatgcgcgagatgctggctaccaccgccgccctgtccgggcagggtatgggcaagaaggttgcactgatcaccgacggccgcttttccggtgcgacgcgcggtttctgcgtgggccacgtcggcccagaggcggcgcacggcgggccgatcgcgctggtggaaaccggcgatgtcatcaccatcaacgcacagaccggagagctgtccgtggacctgacggacgagcaactggcggcccgcaaggacgcttggagcgggccgcgggacacgatctatgcctccgggtcgctgtggaaatatgcgcaactcgttggggagacatacaaaggcgccgtcacccatccaggtggcaaggcggagaaacacgtctacgccgatctctga

SEQ ID NO: 80 - protein, 577 aa, Sagittula stellata
MLKRPFDKTKLPSRHVTEGPARAPHRSFMYAMGLSEEEIHQPLIGVATCWNEAAPCNISLSRQAQAVKLGVKEASGTPREFTTITVTDGIAMGHEGMRASLASREAIADTVELTMRGHCYDALVGLAGCDKSLPGMMMAMVRLNVPSVFIYGGSIMPGKFQGRDITVQDVFEAVGKHQAGANSDEELRAIEKAACPSAGACGGQFTANTMACVSEAIGLALLNSSGAPAPYESRDQYGTASGIAVMNLLERNIRARDIVTMKSLENAARVVACTGGSTNAGLHLPAIAHEAGLEFFLDDVCEIFRDTPYFVDLKPGGNYVAKDLYEVGGVPVVMKELREAGLIHEDCITASGRSMGEELDLIEREADGKVIYPIETPITKTGGVVGLKGNLAPQGAIVKVAGIAAEDQVFTGPARVFECEEDCFEAVKMRAYKEGEVLVIRNEGPAGGPGMREMLATTAALSGQGMGKKVALITDGRFSGATRGFCVGHVGPEAAHGGPIALVETGDVITINAQTGELSVDLTDEQLAARKDAWSGPRDTIYASGSLWKYAQLVGETYKGAVTHPGGKAEKHVYADL

SEQ ID NO: 81 - DNA, 1758 bp, Roseobacter sp.
atgaccaaattcgacaaatccaaactgcccagccgttacgtgaccgaaggaccggcccgcgcgccgcatcggtcctattactatgccatgggcatgaccgaggccgagatccatcagccgctggtcggcgtggcgacctgctggaacgaggcggcgccgtgcaacatcgcgctcaaccgtcaggcgcaggccgtcaagggcggcgtcaaggaagcgcatggcagcccgcgtgaattcaccacgatcaccgtgaccgacgggatcgccatgggccatgaaggcatgcgcagctcgcttgccagccgcgaggcgattgccgacactgtcgagctgaccatgcggggccattgctatgacgcgcttgtgggtcttgcgggctgtgacaagtcgctgccgggcatgatgatggcgatggtgcggctcaatgtgccgtcagtgttcatctatggcgggtcgatcctgccgggcaaggcgcctcaggtgaacgaaatccccgaagaattccgcaaccgcgacctgacggtgcaggatatgttcgaagcggtcggctggcaccagaacgagcagatgtccgacaaggcgctcgatatgctcgaacgcgtcgcctgcccctcggcgggcgcttgcggcgggcagttcaccgccaacacaatggcctgcgtctccgaggcgatcggccttgcgctgatgaacagctcgggcatgcccgcgccctacgaatcccgcgaccaatatgccgaggcgtcgggccgcgcggtcatgacccttctggaaaagaacatccgtgcgcgggacgtggtcaccctccaaagcctgcagaacgccgcgcgcgtcgtggcctgcaccggcggctccaccaatgcgggcctgcaccttccggccatcgcccatgaggcggggatcgacttcttcctcgaagatgtctgcgagattttccgcgacacgccctatttcgtcgatctcaagcccggtggtcagtatgtggccaaggatctctatgatgcgggcgggattcccgtcgtgatgaaagagctgcgcaaggcggggctgatccacgaggattgcatcaccgcctcgggccgctccatcggcgaagagcttgacctgatcgaacgcgaggccgatggccgcgtgatctatccgatcgaaaagccgatcaccaagaccggcggtgtcgtcggcctcaagggcaatcttgcgccgcaaggcgccatcgtgaaggtcgcgggcatcgcccccgagcatcaggtcttcaccggcccggcgcgcgtgttcgaatgcgaagaggacgcgttcgaggcggtcaaggcgcgccaatacaaggaaggcgaggtcatcgtgatccgcaacgaaggccccgcaggcggccccggcatgcgcgagatgctgtccacgaccgccgcgctgtccgggcagggcatgggcaagaaggttgcgcttatcaccgatgggcgcttttcgggcgccacacgcgggttctgtgtgggccatgtcggccccgaggcggcgcatggtggcccgatcgccctgatccagaccggcgatgtggtcaccatcgacgcgatcaagggcgaactgagcgtcgatctatcggacgaggagctggccaagcgcaaggaaaactgggccggcccgcgcgagacgatctatgccaccggtgcgatctggaaattcgccaagcttgtgggcgagacctacaagggggctgtcacccatcccggcggcaaggccgagcggcatgtctacatggacctctga

SEQ ID NO: 82 - protein, 585 aa, Roseobacter sp.
MTKFDKSKLPSRYVTEGPARAPHRSYYYAMGMTEAEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVNEIPEEFRNRDLTVQDMFEAVGWHQNEQMSDKALDMLERVACPSAGACGGQFTANTMACVSEAIGLALMNSSGMPAPYESRDQYAEASGRAVMTLLEKNIRARDVVTLQSLQNAARVVACTGGSTNAGLHLPAIAHEAGIDFFLEDVCEIFRDTPYFVDLKPGGQYVAKDLYDAGGIPVVMKELRKAGLIHEDCITASGRSIGEELDLIEREADGRVIYPIEKPITKTGGVVGLKGNLAPQGAIVKVAGIAPEHQVFTGPARVFECEEDAFEAVKARQYKEGEVIVIRNEGPAGGPGMREMLSTTAALSGQGMGKKVALITDGRFSGATRGFCVGHVGPEAAHGGPIALIQTGDVVTIDAIKGELSVDLSDEELAKRKENWAGPRETIYATGAIWKFAKLVGETYKGAVTHPGGKAERHVYMDL

SEQ ID NO: 83 - DNA, 1758 bp, Roseovarius sp.
atgaccaagttcgacaaagccaaactgcccagccgtcacgtgaccgaagggcccgagcgcgcgccgcatcggtcctattactatgccatgggcatgaccgagacggaaattcatcagccgctcgtgggcgtggcgacctgctggaacgaagcagccccctgcaacatcgcgctgaaccgtcaggcgcaggcggtcaagggtggcgtgaaagaggcgcatggcagcccgcgtgagtttaccacgatcacggtcacggacgggattgcgatggggcatgagggcatgcggtcgagccttgcgagccgggaggcaattgccgatacggtggaattgaccatgcgtggacattgctatgacgcgctggttggtttggcgggttgtgacaaatccctgcctggaatgatgatggcgatggtgcggttgaacgtgccgtccgtgttcatttatggcgggtcgatcctgccgggcaaggccccgcaggtcgaggagattccggcggatttccgcagccgtgatctgaccgtgcaggacatgttcgaggcggtggggcggcatcagaacaacgagatgtccgacaaggcgctggatatgctggagcgggtggcctgcccatcggcgggggcctgtggcgggcagttcaccgccaacaccatggcctgtgtttctgaggcgattggtctggcgttgatgaattcctcgggtatgcctgccccttatgaaagccgcgatcaatatgccgaggcgtctggtcgtgcggtgatgcatcttttggagcgcaacatccgggcgcgggacgtggtgacgctcaagtcgttgcagaatgcggcgcgggttgtggcctgcaccggtggcagcaccaatgccggtttgcacctgcctgcgattgcgcatgaggcggggattgatttctttctcgaagatgtctgcgacatcttccgcgacacgccctatttcgtcgatctgaaaccgggcggggcctatgtggccaaagacctttatgatgccggtggtatcccggttgtgatgaaggaattgcgcaaggccggtctgattcatgaggattgcatcaccgcgagcgggcgcagcatcggcgaggagctggacctgatcgagcgcgaagccgatggcaaggtcatctatccgattgaaacgccgatcaccaagacggggggcgttgtcggtctcaagggcaatctggccccgaccggcgcgattgtgaaagtggcgggcattgcgcccgagcatcaggtctttaccggcccggcgcgggtgtttgaatgtgaagaagacgcattcgaggccgtcaaagcgcgcgcctataaagagggcgaggtgatcgtcatccgcaatgaaggcccggcaggcggccccggcatgcgcgagatgctgtcgaccacagcggcgctgagcggtcagggcatgggcaagaaggtggcgctgatcaccgacgggcggttctctggggcgacacgcgggttctgtgtgggccatgttggaccagaggccgcgcatggtggcccgattgccttgattgccacgggcgacatgatcacgattgacgcgatcaagggggaattgtcggttgatctgagcgacgaggaactggccaagcgcaaggacgcttggggcgggccgcgcgagacgatctataccagcggggcgctgtggaaatatgcgcaattggtgggcgagacctataagggcgctgtgacccatcccggcgcagcgttcgagcggcatgtctatatggacctctga

SEQ ID NO: 84 - protein, 585 aa, Roseovarius sp.
MTKFDKAKLPSRHVTEGPERAPHRSYYYAMGMTETEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVEEIPADFRSRDLTVQDMFEAVGRHQNNEMSDKALDMLERVACPSAGACGGQFTANTMACVSEAIGLALMNSSGMPAPYESRDQYAEASGRAVMHLLERNIRARDVVTLKSLQNAARVVACTGGSTNAGLHLPAIAHEAGIDFFLEDVCDIFRDTPYFVDLKPGGAYVAKDLYDAGGIPVVMKELRKAGLIHEDCITASGRSIGEELDLIEREADGKVIYPIETPITKTGGVVGLKGNLAPTGAIVKVAGIAPEHQVFTGPARVFECEEDAFEAVKARAYKEGEVIVIRNEGPAGGPGMREMLSTTAALSGQGMGKKVALITDGRFSGATRGFCVGHVGPEAAHGGPIALIATGDMITIDAIKGELSVDLSDEELAKRKDAWGGPRETIYTSGALWKYAQLVGETYKGAVTHPGAAFERHVYMDL

SEQ ID NO: 85 - DNA, 1758 bp, Oceanicola batsensis
atgacgaaattcgacaaatcccggctgcccagccgatacgtcaccgaaggacccgagcgcgcgccgcaccgctcctacctctatgccatggggatttccgaagaagagatccaccagccgctcgtcggcgtggcgacctgctggaacgaggccgcgccctgcaacatcgcgctgaaccgccaggcgcaggccgtcaagctgggcgtgaaggcgcgcgaaggcacgccgcgcgaattcaccaccatcaccgtcaccgacggcatcgccatgggccacgaggggatgcgatcctccctcgcctcgcgcgaggccatcgccgacacggtggagctgaccatgcgcggccactgctacgacgcgatcgtcggactggcgggctgcgacaagtccctgcccggcatgatgatggccatggtacgtctgaacgtgccctcggtcttcatctacggcggttcgatcctgcccggcaaggcaccgcaggtcgacgagatccccgaggacttccgcacccgcgacctgaccgtgcaggacatgttcgaagcggtcggccgtcaccagaacaaggagttgtcggacgctgcgctcgacatgctggaacgggtggcctgcccctcctccggcgcctgcggcggccagttcaccgccaataccatggcctgcgtctccgaggcgatcgggctggcgctgctcaactcctccggcatgcctgcgccctacgagagccgcgaccagtacggcgaggcctcgggccgcgcggtcatgaacctgatcgagaagaacatccgcgcccgcgatgtcgtcacccgcaagtcgctggaaaacgccgcgcgcgtcgtggcctgcaccggcggctcgaccaacgccggcctgcacctgcccgcgatcgcgcacgaggccggcatcgactttcaccttgatgacgtctgcgagatcttccgcgacacaccctatttcgtgaacctcaagccgggcggcgaccacgtggccaaggacctgttcgacgtcggcggcatcccggtggtgatgaacgaactgcgcaaggccggcctgatccacgaggactgcgtcacggcctcgggcaagaccatcggcgaggaactcgacaccgtcacccgcaaggccgacggcaaggtgatctatccgatcgagacgccgatcaccaagaccggcggcgtggtgggcctcaagggcaacctcgcccccgaaggcgccatcgtgaaggtcgcgggcatttcggccgaggatcagaagttcaccggccccgcccgggtcttcgaatgcgaggaagacgcctttgccgccgtgcagaaacgggaatacgaggaaggcgaggtcatcgtcatccgcaacgagggccccgcgggcggtcccggcatgcgcgagatgctggccaccaccgccgccctgtccggccagggcatgggcaagaaggtcgcgctgatcaccgacggccgcttttccggcgcgacgcgcggcttctgcgttggccatgtcggccccgaggcagcgcatggcggcccgatcgcgatgctcaagaacggcgacatgatcaccatcgacgccatcgagggttcgatcgaggtcgacctctccgaggccgaactcgaggcgcgcaaggccgactggacgggccctcgcgagacgatctacgcctcgggcgcgctctggaaatatgcgcagctggtcggcaagacctatctcggcgctgtcacccatcccggcggcaaggccgagaaacatatctatgccgatctctga

SEQ ID NO: 86 - protein, 585 aa, Oceanicola batsensis
MTKFDKSRLPSRYVTEGPERAPHRSYLYAMGISEEEIHQPLVGVATCWNEAAPCNIALNRQAQAVKLGVKAREGTPREFTTITVTDGIAMGHEGMRSSLASREAIADTVELTMRGHCYDAIVGLAGCDKSLPGMMMAMVRLNVPSVFIYGGSILPGKAPQVDEIPEDFRTRDLTVQDMFEAVGRHQNKELSDAALDMLERVACPSSGACGGQFTANTMACVSEAIGLALLNSSGMPAPYESRDQYGEASGRAVMNLIEKNIRARDVVTRKSLENAARVVACTGGSTNAGLHLPAIAHEAGIDFHLDDVCEIFRDTPYFVNLKPGGDHVAKDLFDVGGIPVVMNELRKAGLIHEDCVTASGKTIGEELDTVTRKADGKVIYPIETPITKTGGVVGLKGNLAPEGAIVKVAGISAEDQKFTGPARVFECEEDAFAAVQKREYEEGEVIVIRNEGPAGGPGMREMLATTAALSGQGMGKKVALITDGRFSGATRGFCVGHVGPEAAHGGPIAMLKNGDMITIDAIEGSIEVDLSEAELEARKADWTGPRETIYASGALWKYAQLVGKTYLGAVTHPGGKAEKHIYADL

SEQ ID NO: 87 - DNA, 1764 bp, Oceanicola granulosus
atgctcaagggcaagctggacaagtcgaaactgccgagccgccatgtgaccgacggtccggcccgcgcgccgcatcggtcctacctctacgcgatgggcctctcggacgaggagatcgcgcagccgctggtcggcgtcgccacctgctggaacgaggccgcgccctgcaacatcgcgctgaaccggcaggcgcagtcggtcaagctgggcgtgcgcgccgcctcgggcacgccgcgcgagttcaccacgatcaccgtcaccgacgggatcgccatgggccacgaggggatgcgctcgtcgctggcgagccgcgaggcgatcgccgacaccgtcgagctgaccatgcgcggccattgctacgacgcgctcgtcgggctcgcgggctgcgacaagtcgctgccggggatgatgatggcgatggtgcggctcaacgtgccgtcggtgttcatctacggcggctcgatcctgccgggcaaggtgccggccggcgccgacgtcccggccgacttcgccacccgcgacctgaccgtgcaggacatgttcgaggcggtcggccggcaccaggccggcgatctgtccgatgccgcgctcgacgtgctcgagcgggtcgcctgcccctccgccggggcctgcggcggccagttcaccgccaacaccatggcctgcgtctccgaggcgatcggcctggcgctgatgaactcctccggcgcgcccgcgccctacgagagccgcgaccagtacagcgtcgcctcgggcgaggcggtgatgaagcttctcgagagcaacatccgcgcccgcgacgtcgtcacccgcaagagcctcgagaacgccgcccgggtcgtcgcctgcaccggcggctcgaccaacgccggcctgcacctgccggccatcgcgcacgaggcggggatcgacttcgacctgttcgacgtctgcgacatcttccgcgacaccccctacttcgtcgacctcaagcccggcggccagtacgtggctaaggacctgttcgaggccggcggcgtgcccgtggtgatgaaggagctgcgcaaggccgggctgctgcacgaggactgcatcaccgccagcggcgagacgctcggcgaggcgctcgacaagatcaccggcgaggccgacggccgcgtcatccatcccgtcgccaccccgatcagcaagaccggcggcgtcgtcgggctgaagggcaacctcgccccggaaggtgcgatcgtgaaggttgccggcatggacgccgagcagcaggtcttcaccggcccggcgcgggtgttcgagtgcgaggaggacgccttcgaggcggtcaaggcgcgcagctacaaggaaggcgaggtcatcgtcatccgcaacgagggccccgccggcggccccggcatgcgcgagatgctggccaccaccgccgcgctctccgggcagggcatgggcaagaaggtcgcgctcatcaccgacggccgcttctcgggcgcgacgcgcggcttctgcgtcggccatgtcggccccgaggccgcccatggcgggccgatcgcgatgctcgagaatggcgacatgatcaccatcgacgccatcaagggcgagatctccgtcgcgctgaccgaggagcagttcgccgagcgcaaggccgcctggccgggcgcgcgcaagacggactacgcctcgggcgcgctgtggaagtacgcccagctcgtcggctccacccgtctcggcgcggtgacccatccgggcgcgaaggcggagacgcacgtctacatggatctctga

SEQ ID NO: 88 - protein, 587 aa, Oceanicola granulosus
MLKGKLDKSKLPSRHVTDGPARAPHRSYLYAMGLSDEEIAQPLVGVATCWNEAAPCNIALNRQAQSVKLGVRAASGTPREFTTITVTDGIAMGHEGMRSSLASREAIADTVELTMRGHCYDALVGLAGCDKSLPGMMMAMVRLNVPSVFIYGGSILPGKVPAGADVPADFATRDLTVQDMFEAVGRHQAGDLSDAALDVLERVACPSAGACGGQFTANTMACVSEAIGLALMNSSGAPAPYESRDQYSVASGEAVMKLLESNIRARDVVTRKSLENAARVVACTGGSTNAGLHLPAIAHEAGIDFDLFDVCDIFRDTPYFVDLKPGGQYVAKDLFEAGGVPVVMKELRKAGLLHEDCITASGETLGEALDKITGEADGRVIHPVATPISKTGGVVGLKGNLAPEGAIVKVAGMDAEQQVFTGPARVFECEEDAFEAVKARSYKEGEVIVIRNEGPAGGPGMREMLATTAALSGQGMGKKVALITDGRFSGATRGFCVGHVGPEAAHGGPIAMLENGDMITIDAIKGEISVALTEEQFAERKAAWPGARKTDYASGALWKYAQLVGSTRLGAVTHPGAKAETHVYMDL

SEQ ID NO: 89 - DNA, 1728 bp, Rhodobacterales bacterium
atgacgaaatttgacaaaaccaacctgcccagccgccatgtaaccgagggtcctgcgcgtgcgccgcatcgttcgtatttatatgctatggggttgtctgaagatgaaattcaccagcctctagtcggtgttgccacatgctggaacgaggcggccccctgtaatatcgccctgaaccgtcaggcgcaatctgtgaaaatgggcgtcaaacaagcgatgggtacgccacgcgaattcaccacgattaccgttacagacggtattgcgatgggtcacgaaggtatgcgttcgtctttggccagccgcgaggcaatcgctgacacggttgaattgaccatgcgcggtcattgctatgatgcgatcgttggtcttgctggttgtgacaagtcattgcccggtatgatgatggcgatgatccgtttaaacacaccgtctgtgtttgtttatggcggttcaatcttgcccggtcgttacgagggtcgcgatgttactgtacaggacgtttttgaggccgtcggccagcaccaagctggaaacctttcgtcttgcgagcttgaaaaactagaagcggttgcttgtccttctgcgggtgcttgtggtggtcagtttaccgccaacaccatggcttgtgtttccgaggcaatcggtcttgccttgccaaattccgcgggcgcaccggcaccgtatgaaagccgtgatcaattctgcgaggcatccggccgcgctgttatgaatttgatcgccaaaaacattcgtgcgcgtgacatcgtaacacgtaaatcattggaaaatgcggcacgtgttgttgcttgtactggtggttcaacgaatgcaggtcttcacttgccagccatggcgcatgaggcaggcattgatttttatctggatgacgtttgtgacatcttccgcgaaacgccttatttcgtcgatctgaaaccaggtggtaattatgtagccaaagacctttatgaggttggtggcgttcccgtaattatgcgtgaattgcgcaaagcggggttgatccacgaggattgcatgacagccactggccgcacaatgggcgaagagattgatcttgttgatcgcgaagcggacggtaaagtgatttaccccgttgatgccccgttgacgaaaactggcggcgttgttggccttaaaggtaacttggccccagaaggcgcgattgtgaaagtggcgggtatcccatcacagcaccaagtgttttccggccctgcccatgtttttgaatgtgaacaggacgcttttgaagccgtgcaaaaccgtgactacaaagaaggcgaagtattcgtcattcggaacgaaggcccatcaggtggccctggcatgcgtgaaatgttggcaacgaccgccgccctttctggtcaaggcatgggtaaaaagatcgccctgattacagatggtcgcttttctggtgcaacacgtggtttctgtgttggtcacgttggaccagaggcggctcatggtggcccgattgcgttggttgaaaatggtgacatcatcaccatcaatgcaattgaaggcgaaatttcggttaatttgactgatgatgagttggctgaacgtaagacaaactggaaaggaccacgcgaaacgatctatgcgtctggtgctttgtggaaatacagtcagcaagttggcgaagtatacaagggtgctgttacccatccaggtggcaaagccgaaaaacacgtttacatggatttgtaa

SEQ ID NO: 90 - protein, 575 aa, Rhodobacterales bacterium
MTKFDKTNLPSRHVTEGPARAPHRSYLYAMGLSEDEIHQPLVGVATCWNEAAPCNIALNRQAQSVKMGVKQAMGTPREFTTITVTDGIAMGHEGMRSSLASREAIADTVELTMRGHCYDAIVGLAGCDKSLPGMMMAMIRLNTPSVFVYGGSILPGRYEGRDVTVQDVFEAVGQHQAGNLSSCELEKLEAVACPSAGACGGQFTANTMACVSEAIGLALPNSAGAPAPYESRDQFCEASGRAVMNLIAKNIRARDIVTRKSLENAARVVACTGGSTNAGLHLPAMAHEAGIDFYLDDVCDIFRETPYFVDLKPGGNYVAKDLYEVGGVPVIMRELRKAGLIHEDCMTATGRTMGEEIDLVDREADGKVIYPVDAPLTKTGGVVGLKGNLAPEGAIVKVAGIPSQHQVFSGPAHVFECEQDAFEAVQNRDYKEGEVFVIRNEGPSGGPGMREMLATTAALSGQGMGKKIALITDGRFSGATRGFCVGHVGPEAAHGGPIALVENGDIITINAIEGEISVNLTDDELAERKTNWKGPRETIYASGALWKYSQQVGEVYKGAVTHPGGKAEKHVYMDL

SEQ ID NO: 91 - DNA, 1734 bp, Paracoccus denitrificans
atgaaaaacagccgcttcgacaagtcgtccctgcccagccgccatgtgaccgaagggccggcccgcgcgccgcatcgcagctatttctatgccatgggcatatcggaggaagaaatccattccccctgggtgggcgtcgccacctgctggaacgaggccgcgccctgcaacatcgcgctggcccgacaggcgcaatcggtcaagcagggcgtcaagaagggtggcggctgcccgcgcgaattcaccaccatcaccgtcaccgacggtattgccatgggacatgaggggatgcgctccagcctcgcctcgcgcgatgccatcgccgatacggtcgagctgaccatgcgcgggcattgctacgacgcgctggtcgggctggcgggctgcgacaagtcgctgccgggcatgatgatggccatggtgcggctgaacgtgcccagcgtcttcatctatggcggctcgatcctgccgggcaagctcaacggccgcgacgtggtggtgcaggacgtgttcgaggcggtgggccagcacgcggccggcaacatgtccgatgccgagctggagatcctggagcgcgtggcctgcccctcggccggggcctgcggcgggcaatataccgcgaacaccatggcttgcgtgtcggaagccatcgggctggcgctgatgaacagctcgggcgcgccggcgccttacgaatcgcgcgaccagtatgggctggcctcgggcgaggcggtgatggcgctgatcgaaaggaacatccgtgcccgcgacgtggtgacgcgcaaatcgctggaaaacgcggcgcgggtggtggcctgcaccggcggctcgaccaatgccgggttgcacctgcccgccatcgcgcatgaggcggggatcgaattcgacctgttcgacgtctgcgagatcttccgcgacacgccctatttcgtgaacctgcgcccgggcggcgattacgtcgccaaggacttgttcgaggccgggggcgtcccggtcgtcatgcgcgaattgcgccgcgccgggctgatccacgaggattgcctgaccgcctcgggccgcagcatgggcgaggagctggacctggtcaagcgcgaggccgacggcaaggtgatccatccggtgacggcgccgctgtccaggaccggcggcgtggtcgggctgcgcggcaacctggcgcccgacggcgccatcgtgaaggtcgcgggaatggcgcccgagcaccaggtctttaccggccccgcccgggtcttcgaatgcgaggaagaggcgttcgaggccgtcgcccgccgcgattacagcgagggctgcgtgatcgtcatccgaaacgaggggccggccggcggccccggcatgcgcgagatgctggcgaccacggcggcgctgtcggggcagggcatgggcaagaaggtggcgctgatcaccgacgggcggttctcgggcgcgacgcgcggcttctgcgtcggccatgtcggtcccgaggcggcgcatggcggccccatcgccctgctgcgcgacggcgacatgatcaccatcgacgcgatcaggggcgagatctcggtggcgctgccggacgaggaactgacgcggcgccgcgccgcatgggcgggaccgcgcaagaccgactatgcctcgggcgcgctgtggaaatacgcccagttggtcggcaaggcgcgctatggcgcggtcacccatccgggcgcggcggccgaaacccatgtctatatggatcagtga

SEQ ID NO: 92 - protein, 577 aa, Paracoccus denitrificans
MKNSRFDKSSLPSRHVTEGPARAPHRSYFYAMGISEEEIHSPWVGVATCWNEAAPCNIALARQAQSVKQGVKKGGGCPREFTTITVTDGIAMGHEGMRSSLASRDAIADTVELTMRGHCYDALVGLAGCDKSLPGMMMAMVRLNVPSVFIYGGSILPGKLNGRDVVVQDVFEAVGQHAAGNMSDAELEILERVACPSAGACGGQYTANTMACVSEAIGLALMNSSGAPAPYESRDQYGLASGEAVMALIERNIRARDVVTRKSLENAARVVACTGGSTNAGLHLPAIAHEAGIEFDLFDVCEIFRDTPYFVNLRPGGDYVAKDLFEAGGVPVVMRELRRAGLIHEDCLTASGRSMGEELDLVKREADGKVIHPVTAPLSRTGGVVGLRGNLAPDGAIVKVAGMAPEHQVFTGPARVFECEEEAFEAVARRDYSEGCVIVIRNEGPAGGPGMREMLATTAALSGQGMGKKVALITDGRFSGATRGFCVGHVGPEAAHGGPIALLRDGDMITIDAIRGEISVALPDEELTRRRAAWAGPRKTDYASGALWKYAQLVGKARYGAVTHPGAAAETHVYMDQ

SEQ ID NO: 93 - DNA, 1767 bp, Oceanibulbus indolifex
atgtccaccaccccacgcttcgacaaatcccggctgcccagccgccacgtgaccgaaggcccggcccgcgcgccgcatcggtcttactactatgccatgggcatgaccgagcaagagattcaccagccgctggtgggcgtcgccacctgctggaacgaagcagcgccctgcaacatcgcgctgagccgtcaggcgcaggccgtgaagatcggtgtgcattccgaacagggcacgccgcgcgagtttaccacgatcaccgtcaccgatggtatcgcgatgggccacgagggcatgcgctcctcgctcgcgtcgcgcgaagcgattgccgacacggttgagctgaccatgcgcggccactgctatgacgccatcgtgggcctcgcgggctgcgacaaatctctgccggggatgatgatggcgatgctgcggttgaacgtgccgtcggtcttcctctatggcgggtcaatcctgccgggcaaagcacctgccggggccgatgtgcccgaggatttcgccagccgcgatctgaccgtgcaggacatgttcgaagcggtgggccggttccagaacggcaccatgtcgcaagcagccctcgacgtgcttgagcgcgtggcttgcccatcggcgggcgcttgtggcggccagttcaccgccaatacaatggcctgcgtctccgaggcgatcggcctcgcgctgcccaactcgtccggcatgcccgcgccctatgagagccgcgacgcctatgccgaggcctctggcgcggcggtgatgaacctgatcgaaaagaacatccgcgcccgcgacatctgcacccgcgaagcctttgaaaacgcagcgcgcatcgtggcctgcaccggcggctcgaccaacgcgggcctgcacctgcccgccatggcgcatgaagccgggatcgagttctacctcgaagacgtttgcgaaatcttccgcgacacaccctatttcgtcgatatgaaaccgggcggcgcttatgtggccaaagatctttacgatgcgggcggcgtgccggtggtgatgaatgagttgcgcaaagcgggcctcattcacgaagactgcatgactgccaccggctactccatgggcgaagtgctcgatcaggttacccgcgaagcagacggcaaggtgatccactcggtcgccaatccgatcagcaagaccggcggtgtcgtgggcctcaaaggcaacctcgcccccgaaggtgccatcgtgaaaatcgcgggcatgtctgacgaagacatcgtcttcaccggcccggcactggtgttcgaatgtgagcaagacgctttcgaagccgtgcaaaaccgcgcctattccgaaggcgacgttttcgtcatccgcaacgaaggccccgcaggcggccccggcatgcgcgagatgctggccaccaccgccgcgctttcgggtcaaggcatgggcaagaaggtggcgctgatcaccgatggccgcttctcgggtgcgacacgtggcttctgtgtgggtcacgttggccccgaagcggcgcatggcggaccgattgcgctgctgaaaaacggcgacatgatcacccttgatgcgatcaaaggttccatcagcgtcgacctgagcgatgatgagcttgccgagcgccgcaagggctgggctggcccgcgtgccacaaactaccaaagcggcgcgctgtggaaatacgccaaacttgtcggccctacctaccttggtgccgtgacacatccgggcgctcaggccgagacccatgattacatggacctctaa

SEQ ID NO: 94 - protein, 588 aa, Oceanibulbus indolifex
MSTTPRFDKSRLPSRHVTEGPARAPHRSYYYAMGMTEQEIHQPLVGVATCWNEAAPCNIALSRQAQAVKIGVHSEQGTPREFTTITVTDGIAMGHEGMRSSLASREAIADTVELTMRGHCYDAIVGLAGCDKSLPGMMMAMLRLNVPSVFLYGGSILPGKAPAGADVPEDFASRDLTVQDMFEAVGRFQNGTMSQAALDVLERVACPSAGACGGQFTANTMACVSEAIGLALPNSSGMPAPYESRDAYAEASGAAVMNLIEKNIRARDICTREAFENAARIVACTGGSTNAGLHLPAMAHEAGIEFYLEDVCEIFRDTPYFVDMKPGGAYVAKDLYDAGGVPVVMNELRKAGLIHEDCMTATGYSMGEVLDQVTREADGKVIHSVANPISKTGGVVGLKGNLAPEGAIVKIAGMSDEDIVFTGPALVFECEQDAFEAVQNRAYSEGDVFVIRNEGPAGGPGMREMLATTAALSGQGMGKKVALITDGRFSGATRGFCVGHVGPEAAHGGPIALLKNGDMITLDAIKGSISVDLSDDELAERRKGWAGPRATNYQSGALWKYAKLVGPTYLGAVTHPGAQAETHDYMDL

SEQ ID NO: 95 - DNA, 1767 bp, Sulfitobacter sp.
atgtccaccaacacccgctttgataaatccagactgccaagccggcacgtgaccgaggggccagagcgcgcaccgcaccggtcctattactacgcaatgggcatgaccgaagaagagattcaccagcctctggtgggtgtggcaacctgctggaacgaagcggccccctgtaacatcgcgctgaaccgtcaggcccaagcggtcaaggtcggcgtcaaggcgcagcaaggcacgccacgcgaattcaccaccatcactgtcaccgacgggatcgccatgggccacgagggcatgcgctcttccctagcgtcgcgcgaagcgattgccgacacggtagagctgacaatgcgcggtcactgctacgatgcgattgtcggtcttgcgggctgtgacaaatcgctgccgggcatgatgatggcgatgctgcggctgaacgtgccgtccgtgttcctctacggtgggtcgatcctgccgggcaaagtcccggaaggggccgatgtgcctgccgatttcgccagccgcgatctgactgtgcaagacgttttcgaagccgtgggtaactaccagaacggcagcatgtcgcaagccgcgcttgaagtattggagcgcgtcgcttgcccgacagccggtgcctgcgggggccagttcaccgccaacactatggcctgcgtgtccgaggcaattggtctggcgctgctgaactcctctggcatgcctgcgccctatgaatcccgcgacgcctatgcggcggcctcgggtgaagccgtcatgaacctgatcgaaaagaacatccgcgcgcgcgacatctgcacccgcgaagcgttcgagaatgcggcgcgtatcgtggcctgcaccggcgggtcgaccaatgccggtctgcacctgcccgctatggccgccgaggcgggtatcgactttaacctcagcgatgtgtgcgacatcttccgcgacacgccttatttcgtcgacatgaaacccggcgggtcgcatgtggcaaaagacctgtatgacgcgggcggcgtgcctgttgtgatgaaagaactgcgcaaggctggcctgctgcatgatgactgtctcaccgcctcgggcctgtccatcggtgaagagctcgacaagatcgaacgcgaagccgacggcaaggtgatccacgcgatcgaaacaccgatcagcaagaccggcggcgtcgttggtctgaagggcaacttggcacccgaaggggccatcgtgaaaatcgcgggcatgtccgaagaagacatcgtctttaccggtccggcgctgatctttgaatgtgaacaggatgcgttcgaagccgtgcaaaaccgggcctacagcgaaggcgacgtgttcgtgatccgcaacgaaggccccgctggtggccccggcatgcgcgaaatgctggcgaccacggcggccctgtccggtcaaggcatgggcaaaaaggtggcactgatcaccgacggccgtttctccggcgcgacacggggtttctgcgttggtcacgtcggccccgaagccgcacatggcggaccgattgccttgctcaaacagggtgacatgatcacactgaacgcgatcaccggttcgatctctgtcgatatctcggacgaggaaatggcagaacgcaaagcggcttggcccggtgcccgcaaaacaaactatcaaagcggtgcactgtggaaatacgcgcagcttgtgggcccaacctatcttggtgcggtgacgcatcccggcgcgaaggcggaaacacatgactatatggacctgtaa

SEQ ID NO: 96 - protein, 588 aa, Sulfitobacter sp.
MSTNTRFDKSRLPSRHVTEGPERAPHRSYYYAMGMTEEEIHQPLVGVATCWNEAAPCNIALNRQAQAVKVGVKAQQGTPREFTTITVTDGIAMGHEGMRSSLASREAIADTVELTMRGHCYDAIVGLAGCDKSLPGMMMAMLRLNVPSVFLYGGSILPGKVPEGADVPADFASRDLTVQDVFEAVGNYQNGSMSQAALEVLERVACPTAGACGGQFTANTMACVSEAIGLALLNSSGMPAPYESRDAYAAASGEAVMNLIEKNIRARDICTREAFENAARIVACTGGSTNAGLHLPAMAAEAGIDFNLSDVCDIFRDTPYFVDMKPGGSHVAKDLYDAGGVPVVMKELRKAGLLHDDCLTASGLSIGEELDKIEREADGKVIHAIETPISKTGGVVGLKGNLAPEGAIVKIAGMSEEDIVFTGPALIFECEQDAFEAVQNRAYSEGDVFVIRNEGPAGGPGMREMLATTAALSGQGMGKKVALITDGRFSGATRGFCVGHVGPEAAHGGPIALLKQGDMITLNAITGSISVDISDEEMAERKAAWPGARKTNYQSGALWKYAQLVGPTYLGAVTHPGAKAETHDYMDL

SEQ ID NO: 97 - DNA, 1764 bp, Roseobacter denitrificans
atgtccagccagcgctttgataaatccaagctgcccagccgccatgtgaccgagggaccctcacgggcgccgcatcggtcctactattacgcgatgggcatgacggaggaagaaatccatcaaccgcttgttggcgtggccacttgctggaacgaggccgccccctgcaacatcgcgctgaaccgccaggcgcaatcggtcaagatgggcgtgaaacgcgaaagcggcacgccacgtgaattcaccaccatcaccgtcaccgacggcatcgcgatgggccacgagggcatgcggtcgtcactggcgtcacgcgaggcaattgccgatacggtggaactgaccatgcgcgggcattgctatgacgcacttgtggggctggcgggctgcgacaaatccctgccgggcatgatgatggcgatgatccgtctgaatgtgccatcggttttcctttatggcgggtcaatcctgccgggacgtgcgcccaagggggcgtcggtgcctgccgaatacgccgaccgcgacctgaccgttcaggacatgttcgaagctgttgggcatcaacagaacggcaccctgagcgaggcagaactcgaagtgctcgaacgcgtcgcctgcccttctgccggggcttgtggcgggcagtttaccgccaacaccatggcctgtgtatccgaggccatcggtctggcgttgcccaattccgccggggcacctgcgccgtacgaatcccgcgacgcctatgccgaagcctcgggtgcggcggtcatgaacctgatcgaaaagaacatccgtgcgcgcgacatctgcacgcgggaggccttcgagaatgccgcgcgcatcgtcgcttgtacgggcgggtcgaccaacgccggtctgcacctgcctgccatggcgcatgaagcgggcatcgatttcttcctcgaagacgtctgcgagatcttccgcgacacgccctatttcgtcgatctgaaaccgggcgggcagtatgtcgccaaggacatgtacgaagccggcggcgtgcccgtggtaatgaaagagctgcgcaaggcaggcctgttgcacgaggactgcatgaccgtcaccggctattccatcggcgaggaactggacaaggtcagccttgaggcggatggccgagttgtctatccgattgaaacaccgctgtcgaaaaccggtggcgtcgtcggcctcaagggcaaccttgcccccgaaggagccatcgtgaaaatcgccggaatggagccgcagcatttgctgttcaccggccctgcgcgaatctttgagtgtgagcaggacgcgtttgaagccgtccagaaccgcacctacaaagagggcgatgtctttgtcatccgcaacgagggccctgctggcggccccggcatgcgcgagatgctggcaacgacggcggcgctttcgggtcagggcatgggcaagaaagtcgcgctgatcacggatggacgtttctcgggggcgacacgcgggttctgcgtcggccatgtgggtcccgaggccgcgcacggaggccccatcgccttgctcaaggatggcgatatgatcacgcttaacgcgatcgaggggaccatcaccgtcgatgtgtccgacgaggagatggccgagcgtaaagccaattggaaaggggcgcgtccaacgatctatggtgctggtgccttgtggaaatacgcgcaacttgtggggccaacctatctcggggccgtgacccatccgggcggtaaagacgaaggccacgcgtacatggaactgtaa

SEQ ID NO: 98 - protein, 587 aa, Roseobacter denitrificans
MSSQRFDKSKLPSRHVTEGPSRAPHRSYYYAMGMTEEEIHQPLVGVATCWNEAAPCNIALNRQAQSVKMGVKRESGTPREFTTITVTDGIAMGHEGMRSSLASREAIADTVELTMRGHCYDALVGLAGCDKSLPGMMMAMIRLNVPSVFLYGGSILPGRAPKGASVPAEYADRDLTVQDMFEAVGHQQNGTLSEAELEVLERVACPSAGACGGQFTANTMACVSEAIGLALPNSAGAPAPYESRDAYAEASGAAVMNLIEKNIRARDICTREAFENAARIVACTGGSTNAGLHLPAMAHEAGIDFFLEDVCEIFRDTPYFVDLKPGGQYVAKDMYEAGGVPVVMKELRKAGLLHEDCMTVTGYSIGEELDKVSLEADGRVVYPIETPLSKTGGVVGLKGNLAPEGAIVKIAGMEPQHLLFTGPARIFECEQDAFEAVQNRTYKEGDVFVIRNEGPAGGPGMREMLATTAALSGQGMGKKVALITDGRFSGATRGFCVGHVGPEAAHGGPIALLKDGDMITLNAIEGTITVDVSDEEMAERKANWKGARPTIYGAGALWKYAQLVGPTYLGAVTHPGGKDEGHAYMEL

SEQ ID NO: 99 - DNA, 1764 bp, Jannaschia sp.
atgaccgccaacaggccagacaaatccagattgcccagtcgccatgtgaccgaaggacccgagcgcgcgccgcatcggtcgtatttctacgccatggacctgacacaggagcagatcgaccagccattcgtcggcgtcgccacctgctggaacgaagcggccccttgcaacatcgcgctcaactggcaggcgcaatcggtgaaacgcggtgtgggtgaggcgaacggtacgccgagggaattcaccacgatcaccgtcaccgacggcattgcgatggggcatgaagggatgcggtcctcgctggcgtcgcgcgatgcgatcaccgacacggtggaactgacgatgcgcggccactgctatgacgcattggtcgggcttgccgggtgcgacaagtccctgcccggcatgatgatggccatggtgcgcctgaacgtgccgtccgtcttcatctatggcggcacgatccttcccggcaaagcgcctgaagttgccgacattcccgccgagtttgccaaccgtgacctgaccgtgcaggacatgttcgaggccgtgggcaagtaccagtccggccaattgagcgaagccgccctggaagttctggaacgcgttgcctgcccgtctgcgggcgcctgtggcggtcagttcaccgccaacaccatggcatgtgtgtccgaggcgattggtctggcaatgctcaactcctccgggatgcctgcgccttacgaggggcggaaggaattcggcgaggcaagcggtcgcgcggtgatgaacctgcttgaaaagaacatccgcgcccgtgacgtcgtcacccgcaaagcgttggagaatgcggcccgtgttgtggcgtgtaccgggggctccaccaatgcaggtctgcaccttcccgcgattgcccatgaggccggaatcgacttcgacctctttgacgtctgcgacatcttcaaggacacgccctacttcgtcgacatgaaacccggcggtcagtatgtggcgaaagacctctatgaggtgggcggcgtgccagtcgtgatgaaggagctgttgaaagaggggctgttgcacggcgattgcctcactgcctctggcgagacgatggaagaggcgctcgacaagatccagggcacgcccgatggccgtgtggtccatacggtccagaacccgatcaccagcaccggcggcgtggtcggcctgcgcggcaatctcgccgaagagggtgcgatcgtgaaagttgcgggcatggatgaggcaagccaggtcttcaccggacccgcgcgcgtgtttgaatgcgaagaagacgcctttgccgccgtgaaggcgcgcggctacgaggaaggcgaagtcattgtcatccgcaatgaagggccaaagggcggcccgggcatgcgggaaatgttggcgacgacggcggcattgtcgggtcagggcatgggcaagaaggtggccctgatcaccgacggccggttctctggtgcaacgcggggcttctgcgtcggtcacgtgggacctgaggcggctgttggcggaccgattggtctgctggagaacagcgacatgatcaccatcaatgcgctgacgggggaactgtcggttgccttgaccgaggcggaattggccgagcgtcggaaggcctgggccggtccgcgtgagacaatgtacgcctctggcgcgttgtggaaatacgcgcaattggtgggagaggcgcgctatggcgcggtgacccatcccggcggggccaaggaaaagcacgtctatgcggacatctag

SEQ ID NO: 100 - protein, 587 aa, Jannaschia sp.
MTANRPDKSRLPSRHVTEGPERAPHRSYFYAMDLTQEQIDQPFVGVATCWNEAAPCNIALNWQAQSVKRGVGEANGTPREFTTITVTDGIAMGHEGMRSSLASRDAITDTVELTMRGHCYDALVGLAGCDKSLPGMMMAMVRLNVPSVFIYGGTILPGKAPEVADIPAEFANRDLTVQDMFEAVGKYQSGQLSEAALEVLERVACPSAGACGGQFTANTMACVSEAIGLAMLNSSGMPAPYEGRKEFGEASGRAVMNLLEKNIRARDVVTRKALENAARVVACTGGSTNAGLHLPAIAHEAGIDFDLFDVCDIFKDTPYFVDMKPGGQYVAKDLYEVGGVPVVMKELLKEGLLHGDCLTASGETMEEALDKIQGTPDGRVVHTVQNPITSTGGVVGLRGNLAEEGAIVKVAGMDEASQVFTGPARVFECEEDAFAAVKARGYEEGEVIVIRNEGPKGGPGMREMLATTAALSGQGMGKKVALITDGRFSGATRGFCVGHVGPEAAVGGPIGLLENSDMITINALTGELSVALTEAELAERRKAWAGPRETMYASGALWKYAQLVGEARYGAVTHPGGAKEKHVYADI

SEQ ID NO: 101 - DNA, 1731 bp, Caulobacter sp.
atgaccaagaaacccgacgggacctgggacaagtcgcaactgcccagccggcatgtaaccgaagggccggcccgcgcgccgcaccgctcttattattacgccatgggtcttggcacgcgtgagatcgcccagccgttcgtcggcgtcgcctcgtgctggaacgaggccgcgccctgcaacaccgccctgatgcgccaggccaacgccgtggccaagggcgtcaaggcggccggcggcaccccgcgcgagttctgcaccatcaccgtcaccgacggcatcgccatgggccacgagggcatgcgttcgtccctggtcagccgcgacgtgatcgccgactccgtcgagctgaccatgcgcggccacggctatgacgcgctcgtgggcgtcgccgggtgcgacaagagcctgccgggcatgatgatggccatgctgcgcctcaacgtgcccagcgtgttcctgtacggcggctcgatcctcccgggacgcttccagggccgcgacatcaccgtgatggacgtcttcgagggcgtcggcgcctatgccgccgggaccatggacgccaagaccctgtgcgagctggagcagcacgcctgcccgtcggacggcgcctgcggcggccagttcacggccaacaccatggcctgcgtgtcggaagccatcggcctggccctgccgctgtcctcggccctgccggccccgtacctggaccgcgaccagtacgcggtggcctcgggcgaggcggtgatgcggctgatcgagcagaacatccgcccgcgcgatatctgcacccgcaaggccttcgagaacgccgccgtcgtcgtcgcggccaccggcggttcgaccaatggcgcgctgcacctgccggccatggcccacgagtgcggcatcgagttcaccctcaaggacgtggccgagatcgccgcccgcacgccctatatcgccgacctcaagcccggcggtcgctacgtggccaaggacatgggcgaggccggcggcgtgccgatgctgctgcgcaccctgctggacgccggcctgctgcacggcgacgtcatgaccgtcaccggcaagaccctggccgagaacctggccgatgtggtctggcgtgaggaccaggacgtgatccgcccggtctccaatccgctgtcgccgactggcggcgtggtcggcctgtggggctcgctggcgcccgagggcggcatcgtcaaggtggccggcctcaagcaccaggtgcaccgcggcccggcccgggtgttcgacggcgaggcggcctgtttcgaagcggtgtcgaaccgcgactacaaggcaggcgacgtcctggtcatccgctacgaaggtccgcgcggcgggccgggcatgcgcgagatgctgtcgacgaccgccgcgatctacggccagggcgtggagaacatcgccctgatcaccgacggccgcttctcgggcgccacgcgcggcctgtgcatcggccacgtgggtcccgaggccgccgtgggcggtccgatcgccctggtgcaggacggcgacatcatcagcatcgacgccaccaaggggacgatcgagcttgaggtcgaggccgaggaactggcgcgccgcaaggccgcctggaagccgcgcggccacgactacaacagcggcgcgatctggaagttcgcccaactggtcggtccagcctatcttggcgccacgacccatccgggcgcggccaaggagacgcacgtctacgcggacatctga

SEQ ID NO: 102 - protein, 576 aa, Caulobacter sp.
MTKKPDGTWDKSQLPSRHVTEGPARAPHRSYYYAMGLGTREIAQPFVGVASCWNEAAPCNTALMRQANAVAKGVKAAGGTPREFCTITVTDGIAMGHEGMRSSLVSRDVIADSVELTMRGHGYDALVGVAGCDKSLPGMMMAMLRLNVPSVFLYGGSILPGRFQGRDITVMDVFEGVGAYAAGTMDAKTLCELEQHACPSDGACGGQFTANTMACVSEAIGLALPLSSALPAPYLDRDQYAVASGEAVMRLIEQNIRPRDICTRKAFENAAVVVAATGGSTNGALHLPAMAHECGIEFTLKDVAEIAARTPYIADLKPGGRYVAKDMGEAGGVPMLLRTLLDAGLLHGDVMTVTGKTLAENLADVVWREDQDVIRPVSNPLSPTGGVVGLWGSLAPEGGIVKVAGLKHQVHRGPARVFDGEAACFEAVSNRDYKAGDVLVIRYEGPRGGPGMREMLSTTAAIYGQGVENIALITDGRFSGATRGLCIGHVGPEAAVGGPIALVQDGDIISIDATKGTIELEVEAEELARRKAAWKPRGHDYNSGAIWKFAQLVGPAYLGATTHPGAAKETHVYADI

SEQ ID NO: 103 - DNA, 1719 bp, Candidatus Pelagibacter ubique
atggcaaaatttaataaaaaaaaattaccaagcagacatacttcattaggtgctgatagagctccacatagatcattttactatgcaatgggtgaaacagaaaaagatgtagcaaagccatttgttggtgttgtgtcaacttggaatgaagctgctccttgtaatattgctttaatgagacaagctcaatctgtcaaaaaaggcgttagagcttcaggtggaacccctagagaattttgtacgataacagtaactgatggtattgccatgggtcacgaaggaatgaagtcatctttaatctctcgcgaggtaattgctgattcaactgaacttactgtgcgtggtcattgttatgatgcgcttgttggtattgctggttgtgataaatctttacctgccttaatgatggcaatggttagattaaatgttccaagtgtatttatttatggtggctcaatacttccaggtcaatataaaggtaaagatgtaactgttgttgatgtttttgaagcagttggaaaacactcagctggaaaaatgtctgcaaaggaattaagaaaattagagttagttgcttgcccaagtgcaggtgcatgtggaggtcaatttactgcaaatactatggcctgcgtttctgaagctattggtttagcattaccttattcagctggaacacctgctccatacgaagaacgtgataagtatgcattattaagtggcaagactgtaatgaatttattacaaaaaaatattcgtccaagagacattgttacaaaaaaatctttagaaaatgctgcaacaattgtagcggctactggtggatcgacaaatgctgctttacacctaccagctatagctaatgaaattggaattaagtttgatttaatggatgtagctaaaatttttaaaaaaactccatatcttgcagatttaaaaccaggtggaaaatatgttgcaaaagatatgtggttagctggtggagtacctatgttattaaaaactctttttgatggtggttttatacatggtgattgcatgactgttactggaaaaacaatgaaacaaaatttaaaaaatattaaatttaatcctaagcaaaaagtattaagagcatatgataatcctttatcaccagatggcggtgttgtaggtcttaaaggtaacttagctcctgatggtggaattgttaaaattgctggtttaaaaaaattacaattcactggaaaagctagatgttttgataatgaagaagcagcaatggcttgtgtgcaaaagaaaaaatataaagcaggtgatgtaattattattcgttacgaaggaccagttggcggtcctggtatgagagaaatgctttcaacaacaggtgctatttatggtcaaggtatgggtgagaaggttgctctaattacagatggtagattttctggggctacaagaggtttttgtgtgggtcatgttggccctgaggcggccttaggcggccctttagctcttttacgcaatggagatgtaattgatatagatgccaaaaaagggactattaacgttagattaactaaatcacaattagccacaagacataagaagtggaaagcaaaaaaatcaagctttggatcgggtactatttggaaatatgctcaaacagtaggtcccgcttatttaggtgcaccaacacatcccggtaaaagaaaagaagtaaaagtttacgctgatatttaa

SEQ ID NO: 104 - protein, 572 aa, Candidatus Pelagibacter ubique
MAKFNKKKLPSRHTSLGADRAPHRSFYYAMGETEKDVAKPFVGVVSTWNEAAPCNIALMRQAQSVKKGVRASGGTPREFCTITVTDGIAMGHEGMKSSLISREVIADSTELTVRGHCYDALVGIAGCDKSLPALMMAMVRLNVPSVFIYGGSILPGQYKGKDVTVVDVFEAVGKHSAGKMSAKELRKLELVACPSAGACGGQFTANTMACVSEAIGLALPYSAGTPAPYEERDKYALLSGKTVMNLLQKNIRPRDIVTKKSLENAATIVAATGGSTNAALHLPAIANEIGIKFDLMDVAKIFKKTPYLADLKPGGKYVAKDMWLAGGVPMLLKTLFDGGFIHGDCMTVTGKTMKQNLKNIKFNPKQKVLRAYDNPLSPDGGVVGLKGNLAPDGGIVKIAGLKKLQFTGKARCFDNEEAAMACVQKKKYKAGDVIIIRYEGPVGGPGMREMLSTTGAIYGQGMGEKVALITDGRFSGATRGFCVGHVGPEAALGGPLALLRNGDVIDIDAKKGTINVRLTKSQLATRHKKWKAKKSSFGSGTIWKYAQTVGPAYLGAPTHPGKRKEVKVYADI

SEQ ID NO: 105 - DNA, 1722 bp, Erythrobacter litoralis
atgtcgtcgagattcgacaagtccaagctgcccagccgccacgtttcggtcgggccagagcgcgcgccgcatcgttcgtattactacgcgatgggtctgaccgagcaggagatcgcgcgacccttcgtcggcattgttagcgcgggcaacgacagcgcgccctgcaacacgacgctcgatgcgcaggcggacatctgtcgcactggcgtcaaccaagcaggcggcatgccgcggcgcttcaacaccatcaccgtgacggacggtatcgccatgggacaccagggcatgaaaagctcgctggtcagccgcgaggtgattgcggactcgatcgagctatcggtgcgcgggcattgctatgatgcgctggtcggattcgccggctgcgacaagagcttgcccggcatgatgatggccatgctgcggctcaatgttccgagcatcttcgtctatggcggatcgatcctgccgggccgcttccacgacaaggacgtgaccgtcgtcgacgtgttcgaagcggtcggccagcacgcggcgggcaattgtccgctgaaagaactgaccgcgctggaaaaggtcgcctgtcccgggcacggcgcgtgcggcgggcagtttaccgccaacaccatggcctgcgtcggcgaagcgatcggcctgtcgctgcccaacagcaatatggcccccgcgccctatcgttcgcgcgaggagatcgcggtggcggcggggcggcaggtcatgacgctgctggagaaaaacctgcgcccgcgtgacatctgcacaagggccgcattcgagaatgcagcacgggtcgtcgcggcaacgggcggctcgaccaatgccgctttgcacctgcctgccatggcccatgaatgcggcatcgacttcgacctgttcgatgtcgccgagacattcaaatcaacaccttatatcgcagacctcaaacctggcgggcgctatgtcgccaaggacatgcacgaggcgggcggggtctacatggcgatgaaaacgctgctggagggcggtttcctcgatcccgaaccgatgaccgtcacaggcaagacgctgggcgagaatatcgaggagatcacctgggaccccgaccagaaggttttctacgacgtatccaatccgatcacgccgaccggcggcgtcgtcgggctcaggggttctctcgcgcccgacggggcgattgtgaaggtggcgggaatggaacggctccagttcagcggcccagcgcgagtattcgattgcgaggaggatgccttcaaggcggtcgagcagcgcgacatcgccgaaggttgcgtcatcgtaatccgctacgaaggccccaagggcggccccggcatgcgcgaaatgctctctactaccgcagcgctctacgggcagggcatgggcgagaaagtggcgctcatcaccgacgggcgcttctccggcgcgacgcgcggcttttgcatcggccatgtcggcccggaagcggcagactgcggcccgattgcgctggtcgaggatggcgatacaatcagcatcgatgccgttgcaggcacgattgagctcgacgtcgatgccgaaacgcttgaaaaacggcgtcaaagctggacaccgcgggcgaacgattaccagtccggcgcgctgtggcgctatgcgaggaacgtcggtcctgcgcatgagggcgcagtgactcatccgggagcgaaatcggaacgccatgtctttgcggatatctag

SEQ ID NO: 106 - protein, 573 aa, Erythrobacter litoralis
MSSRFDKSKLPSRHVSVGPERAPHRSYYYAMGLTEQEIARPFVGIVSAGNDSAPCNTTLDAQADICRTGVNQAGGMPRRFNTITVTDGIAMGHQGMKSSLVSREVIADSIELSVRGHCYDALVGFAGCDKSLPGMMMAMLRLNVPSIFVYGGSILPGRFHDKDVTVVDVFEAVGQHAAGNCPLKELTALEKVACPGHGACGGQFTANTMACVGEAIGLSLPNSNMAPAPYRSREEIAVAAGRQVMTLLEKNLRPRDICTRAAFENAARVVAATGGSTNAALHLPAMAHECGIDFDLFDVAETFKSTPYIADLKPGGRYVAKDMHEAGGVYMAMKTLLEGGFLDPEPMTVTGKTLGENIEEITWDPDQKVFYDVSNPITPTGGVVGLRGSLAPDGAIVKVAGMERLQFSGPARVFDCEEDAFKAVEQRDIAEGCVIVIRYEGPKGGPGMREMLSTTAALYGQGMGEKVALITDGRFSGATRGFCIGHVGPEAADCGPIALVEDGDTISIDAVAGTIELDVDAETLEKRRQSWTPRANDYQSGALWRYARNVGPAHEGAVTHPGAKSERHVFADI

SEQ ID NO: 107 - DNA, 1716 bp, Erythrobacter sp.
atgtccttcgataagtccaagttgccaagccgccatgtctcggtcgggcctgaacgcgcgccccaccgttcctactattacgcgatgggcatgaccgaggaagaaatcgcacgccccttcgtcgctgtggccagtgctggtaacgattccgcgccgtgcaacacaacgctcgatccgcaggcgaatatctgtcgcgaaggcgtcattgcggggggagggaccccgcgccgcttcaacaccatcacggttacggacgggatcgcgatgggccatcagggcatgaagagctcgctggtaagtcgcgaggtcattgcggactccgtcgagctttcggtgcgcggtcattgttacgatgcgcttgtaggatttgccggatgcgacaaaagcctgcccgggatgatgatggccatgctgcggctgaacgtgccgagcatctttgtctatggcggctcgatcctcccaggcactcatcgcggcaaggacgtgacggtcgtcgatgtgttcgaagccgtgggccagcatgctgccgggaattgcccgcttcaggagttgatcgagctcgaaaaggttgcctgtcccggacacggagcctgtggcggccagttcacagccaatacgatggcctgcgtgggtgaggcaatcggattgtcattgccgaacagcaacatggctcctgctccttacagatcgcgtgaagaaatcgctcgcgccgcgggcgagcaggtgatgatactgcttaagcaaaatctgcgcccacgcgacatctgcacgcgcgcggcctttgaaaacgcggcccgcgttgtcgccgcaaccggcggttctaccaatgccgctctgcaccttcctgccatggcgagcgaatgcgggattgatttcgatcttttcgacgttgcggagatcttcaaatcgacaccctacatcgccgacctgaagcccggcggtaagtacgtcgcaaaggacatgcacgaagcgggcggcgtctacatgggcatgaagacactgctcgaaggagggttcctcgatcccgggccgatgactgtgaccggcaagacgctgggcgagaacatcgaggagatcacctggaaccccgatcaaaaggtattctacgacgtaaagaacccgatcaccccgaccggcggtgtggttgggcttaagggctcgctcgcgcccgaaggtgcgatcgtaaaggttgccgggatggaacgtttgcaattcaccggcacggctcgcgtattcgaatgcgaggaagatgccttcgaggcggtcgagaagcgcgacattgtcgaaggcagcgtcatcgtcatccgctacgaaggccccaagggtggacctggaatgcgcgagatgctcgccaccaccgctgcgctttacggccagggtatgggtgagaaagtcgccctcatcacagatgggcggttctcaggcgctacgcgtggtttctgtatcggccatgtcggccctgaagccgcggatggcggaccgatcgctctcgtcgaggatggcgacacgatcagcatcgatgccgagcttggcacgatcgacctggaggtcgaccaaagcgtgcttgaagaacgccgaaaagcatggaagccgcgtacgaacgattatcagtcgggggcgctgtggcgttacgcgcagaatgtcgggtccgcacgaaacggagcgctcactcacccgggcgccaagtctgagacccatgtgtttgcggacatctag

SEQ ID NO: 108 - protein, 571 aa, Erythrobacter sp.
MSFDKSKLPSRHVSVGPERAPHRSYYYAMGMTEEEIARPFVAVASAGNDSAPCNTTLDPQANICREGVIAGGGTPRRFNTITVTDGIAMGHQGMKSSLVSREVIADSVELSVRGHCYDALVGFAGCDKSLPGMMMAMLRLNVPSIFVYGGSILPGTHRGKDVTVVDVFEAVGQHAAGNCPLQELIELEKVACPGHGACGGQFTANTMACVGEAIGLSLPNSNMAPAPYRSREEIARAAGEQVMILLKQNLRPRDICTRAAFENAARVVAATGGSTNAALHLPAMASECGIDFDLFDVAEIFKSTPYIADLKPGGKYVAKDMHEAGGVYMGMKTLLEGGFLDPGPMTVTGKTLGENIEEITWNPDQKVFYDVKNPITPTGGVVGLKGSLAPEGAIVKVAGMERLQFTGTARVFECEEDAFEAVEKRDIVEGSVIVIRYEGPKGGPGMREMLATTAALYGQGMGEKVALITDGRFSGATRGFCIGHVGPEAADGGPIALVEDGDTISIDAELGTIDLEVDQSVLEERRKAWKPRTNDYQSGALWRYAQNVGSARNGALTHPGAKSETHVFADI

SEQ ID NO: 109 - DNA, 1815 bp, Comamonas testosteroni
atgaacgattcccgctccaccgatccccaggccgctgtcagcggccacgctgaaccctccgactcctctgtgtcatcctccgccccgggcctgcgctcggccatcgtgcaccgcggcaccttgcgcgccagcgcgcgcagctttctgcatgcgctgggccaggacgatgaggagattgcacgcccgcatgtgggcgtgttccatacgggcggggagatgagcccctgcaatatgaatctccgcgaccaggcccagcatgccaagaccggcatctacgcgggaggcggcatgccgcacgagtgccccgtggtctcggtcagcgacggcctgaccatggcgcattcgggcatgcgcttttcgctgatctcgcgcgagctcatcgccgacagcgtggaggcctcggtgcgcggccaccagtgggacggtatctttgccgtgggtgcctgcgacaagaacctgccgggcctgatgatggccatggtgcgctgcaatgtgcccagcgtcttcgtgcatggcggctcggccctgcccgggcagatgccgggcagcgtatcggggcgcgcccttaacgtggtcgacacctacgagaccataggcaaggtgctggccggcacttccaccatgcaggagctggacaccgtcacgcgctcctgcctgccctcggccggggcctgtgccgggcagttcacggccaacaccatgggcatggtcagcgaggccctgggcctggcgcccataggctccagcatggtgccggccgtgttcagcgaacgcgcgccgctgatgcgccgcgcgggccgtcagctcatggaaatggtgtgggccagcgccaggggagaggccgtgctgccgcgcgacatcgtcacgcgcaaggccctggaaaatgcctgtgccgtggtctgcgccacgggtggctccacgaatgcggccctgcacctgccggcgatcgcgcacgaggccggcatacgctttcacctcgacgacgtggccgagatctttgcgcgcacgccgctgatcgcagacctcaagcccggcggccgcttcctggcacgtgatgtctactacatcggcggtgcggctgtcatcctgcgcaccctgctggagcagggcctgctgcatggcgatgcactcaccttcacgggccgcacgctggccgaggaggtggccgatgctgccgagcccgacggcgaagtggtgcgcaaggccggcaacccgatctcggccgacggtgggctcacggtgctcaagggcaatctgtgccctgacggtgccctgctcaagacggcggggctcaagaccctggtgcaccgcggtccggcccgcgtcttcgactccgaggaacaggcgcaggacgccgtgcaggccatggcctaccggagcggcgatgtgctggtgatacgcaacgaaggccccaagggcagccccggcatgcgcgagatgctgggcatcactgccttgctctatggccagggcatgggcgacaaggtggcactgctcaccgacgggcgcttctcgggcgccacgcgcggcctgtgcataggctacgcggggccggaggccgctgacggtgggccgattgccgcactgcaggacggcgacatcatcgccatcgatgcgcgggccggcgcgcgcagcatcacggtggagctggagcccgccgtcattgccgcgcggctggaagccgcccgggccagccgtgcgcagcagcgccccctgggcgggctgctggagaaatacgcgctgaccgtgcgtcccgcccaccagggcgcggtcacgcattcgggggcggtgacctggctgcgcgacagcaagtga

SEQ ID NO: 110 - protein, 604 aa, Comamonas testosteroni
MNDSRSTDPQAAVSGHAEPSDSSVSSSAPGLRSAIVHRGTLRASARSFLHALGQDDEEIARPHVGVFHTGGEMSPCNMNLRDQAQHAKTGIYAGGGMPHECPVVSVSDGLTMAHSGMRFSLISRELIADSVEASVRGHQWDGIFAVGACDKNLPGLMMAMVRCNVPSVFVHGGSALPGQMPGSVSGRALNVVDTYETIGKVLAGTSTMQELDTVTRSCLPSAGACAGQFTANTMGMVSEALGLAPIGSSMVPAVFSERAPLMRRAGRQLMEMVWASARGEAVLPRDIVTRKALENACAVVCATGGSTNAALHLPAIAHEAGIRFHLDDVAEIFARTPLIADLKPGGRFLARDVYYIGGAAVILRTLLEQGLLHGDALTFTGRTLAEEVADAAEPDGEVVRKAGNPISADGGLTVLKGNLCPDGALLKTAGLKTLVHRGPARVFDSEEQAQDAVQAMAYRSGDVLVIRNEGPKGSPGMREMLGITALLYGQGMGDKVALLTDGRFSGATRGLCIGYAGPEAADGGPIAALQDGDIIAIDARAGARSITVELEPAVIAARLEAARASRAQQRPLGGLLEKYALTVRPAHQGAVTHSGAVTWLRDSK

SEQ ID NO: 111 - DNA, 1707 bp, Sphingomonas wittichii
atgacgacccgaaaatttcgatccgagatcatccgcgaaggcgtggtccgaacgaccacgcgcagcttcctctacgccctgggcgaggacgacgaggatctgcggcagcctcatgtcgccgtcatccacaccggcggcgagatgagcccgtgcaacaccacgctgcgcgatcaggcgctccacgccaagacgggcatctatgcgggtggcggcacggcgcatgaatgcccggtggtgtcggtgtcggacgggctgtcggtggcgcattcggggatgcgcttctcgctgatctcgcgcgagctgatcgccgacagcgtggaggcgaccgtccggagccatcaatgggatggcgtcctcgcggtcggcggctgcgacaagaacatgcccggcctgatgatgggcatcgtgcgctgcaacgtcccctcggtcttcctctatggtggggcagccctgcccggccatctcggcggccgcgacgtcaacatcgtcgacacctatgagatgatcggccgggtcctggcgggagaggcgacgcaaggggaactggaggacatggcccgcgcctgtcttccgacggcgggagcctgtgccggccaatataccgccaacaccatgggcatggtgtcggaagcgctcggcctggcgctgctgggctcctcgatgatcccggcggtctatgccgcccgggcgccgatggcgcgcaaggcgggcaaggtgctgatgcgagcggtgctcggcggtgggccgctgccgcgcgacatcgtcacccgcaaggcgctggaaaatgcctgcgccgtggtcgccgccaccggcggttcgaccaacgcgccgctgcaccttcccgcgatcgccaacgaagcggggatcgatttcgacctcgacgatgtcgccgcagtgctcgcccgcacgccgctgatcgccgatctcaagcccggcggccgcttcctggccaaggacgtgttcgagatcggcggcaccccggtgatcctgaaggccctgctcgacggcggccatctccatggcgactgcatgacggtcaccgggcggacgctcgccgaagacctcgccaaggtctgcccgccggacggggcggtggtccgcgactgcggcatgccgatcgcgccgtccggcggcgtgaccgtgctcaagggcaatctggccccagacggcgcactgctgaagaccgccggcctgaagaagctcgagcatcgcggccccgcccgcgtcttcgagtccgaggagcaatgcctctccgccgtgcgggcgatggcctatgcggccggcgacgtcatcgtgatccgcaacgaagggccgcgcggcggccccggtatgcgcgagatgctgggcatcaccgcgctgctctacggccagggcatgggggagaaagtcgccctgatcacggacggccgcttctcgggcgcgacccggggcatgtgcatcggctatatctcgcccgaagcggccagtgatggaccgatcggcctggtccgcgacggtgatctcatcgccatcgacgcgcgcgacggcatcgtcagtttgcaggtcgaactgccaaaaggtgagttggaggcgcgtcgcgccctgccccgccccgcccgtgttcgtccgaaaggaggggtcctcgaaaaatatgcggcgatcgttggaccggccaacaagggcgccgtaacccatagcggcaacgtcatatgggagatggatccgtga

SEQ ID NO: 112 - protein, 568 aa, Sphingomonas wittichii
MTTRKFRSEIIREGVVRTTTRSFLYALGEDDEDLRQPHVAVIHTGGEMSPCNTTLRDQALHAKTGIYAGGGTAHECPVVSVSDGLSVAHSGMRFSLISRELIADSVEATVRSHQWDGVLAVGGCDKNMPGLMMGIVRCNVPSVFLYGGAALPGHLGGRDVNIVDTYEMIGRVLAGEATQGELEDMARACLPTAGACAGQYTANTMGMVSEALGLALLGSSMIPAVYAARAPMARKAGKVLMRAVLGGGPLPRDIVTRKALENACAVVAATGGSTNAPLHLPAIANEAGIDFDLDDVAAVLARTPLIADLKPGGRFLAKDVFEIGGTPVILKALLDGGHLHGDCMTVTGRTLAEDLAKVCPPDGAVVRDCGMPIAPSGGVTVLKGNLAPDGALLKTAGLKKLEHRGPARVFESEEQCLSAVRAMAYAAGDVIVIRNEGPRGGPGMREMLGITALLYGQGMGEKVALITDGRFSGATRGMCIGYISPEAASDGPIGLVRDGDLIAIDARDGIVSLQVELPKGELEARRALPRPARVRPKGGVLEKYAAIVGPANKGAVTHSGNVIWEMDP

SEQ ID NO: 113 - DNA, 1767 bp, Burkholderia xenovorans
atgaccaatctgcataaacaccgctcccgcatggtgaccgatggtgtgacgcgtgcgccgcaccgtgcctttctgcgcgcgacaggcctcgacgatgcgtcgatgcaaaagccgttcgtcgcgatcgtcgatacgtttggcgagaacacgccgtgttcgatgtcgctgaaccaggtgtccgataacgcacgtctcggcgttgccgctggcggcggcataccgattcgcggctcggcgatctcggtgtcggacggtacctcgatgaatcattcggggatgcgcatgagccttgtatcgcgcgagatcgtcgcggacagcgtcgagctgttcgtgcgtgcccatgcctacgatgcgctgatcggcgtggccggctgcgacaagacgctgcccggcatcctgatgggcatggttcgcgtcaacgtgcccggcgcgttcctgttcggcggcgcgatgctgccgggcgtggcgcccgggcagatccccggcggaggcggcacgggccagcaacgccaggcaacgatcctcacgaccatcgaagcggtgggcaccgcgcagcgcggcgacatcacccgcgcgcagctcgacgccatcgaaaagcagtgcacgccgaccgccggctcatgtcccggccagttcaccgcgaacaccatggcgatggtcgcggaagcgctgggactcgccccgctcggctcggcgatggtgccggccgtctatagcgaacgcattgcgattgcgcggcgcgctggcgaaacggtgatgcgcacgctcaaggaaggcgccccgctgccacgcgatctggttacgctgaaaagcctggagaatgcctgcgccgccgttgccgcgacgggcggctcgaccaacgccgcgctgcacattccggcgatcgcgcatgaagccggcatccgcttcacgctcgacgacgtgcagcgcgtgttcgcgcgcattccgctgatcggcgacctgcagcccggcggccgctatctcgcgcaggacctgcatcatgcgggcggcgtgccggcggtgctcaacgcgttgctggccggtggctatctgcatggcgacgccctcacgctcgacggcctcacgctggaagacgcgttgcgcggctacgccggtcccgatggcacggtggtgcgttcatgcgatgaaccgctcggcgagaacggcggcctcgtgatcctgcgcggcaatctcgcaccggacggtgcgtgcctgaaaatcgccgggctcaaagcgctgaccttctcaggtaagacgcgcatcttcgaatgcgaggaagactgcatggcggtggtcgctgcacgcgattatcgcgaaggcgacgtcctcgtgatccgcaacgaagggccgaagggcggtcccggcatgcgggagatgctcagcgtgaccgcggcgatctacggacaaggcatgggcgagaaagtcgcgctgctgaccgatggacgcttttcgggggcgacgcgcggcatgtgtatcggttatgtcggaccggaagcggcggtgggcggtccgattgcgctgctgcgcgatggtgatcgggtgcagatcgatgcgcgcgcgggaacgctgcgcgtcgagctatccgacgacgaactcgcgcgacgccgtgcggatctgccggcgaggccaaggcgccggctcgccggcgtgctggagaagtacgaggcgctggtgcggcctgcgcatctcggggcggtcacgcattcgggcaatctcgattggccctacgatgcgccgacgcatggcgacgacggagccgccgcgtga

SEQ ID NO: 114 - protein, 588 aa, Burkholderia xenovorans
MTNLHKHRSRMVTDGVTRAPHRAFLRATGLDDASMQKPFVAIVDTFGENTPCSMSLNQVSDNARLGVAAGGGIPIRGSAISVSDGTSMNHSGMRMSLVSREIVADSVELFVRAHAYDALIGVAGCDKTLPGILMGMVRVNVPGAFLFGGAMLPGVAPGQIPGGGGTGQQRQATILTTIEAVGTAQRGDITRAQLDAIEKQCTPTAGSCPGQFTANTMAMVAEALGLAPLGSAMVPAVYSERIAIARRAGETVMRTLKEGAPLPRDLVTLKSLENACAAVAATGGSTNAALHIPAIAHEAGIRFTLDDVQRVFARIPLIGDLQPGGRYLAQDLHHAGGVPAVLNALLAGGYLHGDALTLDGLTLEDALRGYAGPDGTVVRSCDEPLGENGGLVILRGNLAPDGACLKIAGLKALTFSGKTRIFECEEDCMAVVAARDYREGDVLVIRNEGPKGGPGMREMLSVTAAIYGQGMGEKVALLTDGRFSGATRGMCIGYVGPEAAVGGPIALLRDGDRVQIDARAGTLRVELSDDELARRRADLPARPRRRLAGVLEKYEALVRPAHLGAVTHSGNLDWPYDAPTHGDDGAAA

SEQ ID NO: 115 - DNA, 1767 bp, Burkholderia phytofirmans
atgaccaatctgcacaaacatcgctcgcgcagggtgaccgacggcgtcacccgcgcgccgcatcgcgcgttccttcgcgctaccggcctcgacgacgaatccatgcaaaagccgttcgtcgcgatcgtcgatacgttcggcgagaacaccccgtgttcgatgtcgctgaaccaggtctccgacaacgtgcgcctcggcattgcagcgggcggtggcgtgccgatccgcggctcggcgatctcggtgtcggacggcacgtcgatgaatcactccggcatgaggatgagcctcgtgtcgcgcgaagtggtcgcggacagcgtcgaactgttcgtgcgtgcgcataactacgacgcactgatcggcgtcgccggttgcgacaagaccttgcccggcatcctgatgggcatggtgcgcgtcaacgtgcccggtgtgttcctgttcggcggcgcaatgctgcccggcgtcgcacccggtcagttgcccggcggcgccggcaccggcctgcaacgccagtcgacgattctcacgacaatcgaagcggtcggcaccacgcagcgtggcgacatgagccgcgcgcaacttgacgccatcgaaaaacaatgcacgccgactgccggatcgtgtcccggccagttcaccgcgaataccatggcgatggtcgcggaaacgcttggcctcgcgccgctgggctccgcgatggtgcccgccgtctacagcgaacggattgcgattgcgcgccgcgccggcgagacagtcatgcgtatcctgacgcaaggcgggcccttgccgcgcgatctcgttacgatggaaagcctggagaacgcctgcgcggcagttgccgcgaccggcggttcgaccaatgccgcgctgcacattccggccatcgcgaacgaggccggcattcgcttcgcgctggacgacgtgcaacgcgtgttcgcgaaaattccgctgatcggcgatctgcaaccaggcggccgctatctcgcgcaggatctgcatcacgcgggcggcgtgccggccgtgttgaacgcgctgctggcaggcggcttcctgcatggcgatgtgcccgcgttcggcggcggcacgctcgccgaagcattgagcgcgttcagcggaccggacggcatcgtcgtgcgtccgtgcgacgagccgctcggcgaaaacggcggactcgtgatcctgcgtggcaacctcgcgccggacggcgcatgtctgaaaatcgccgggctcaaatcgctttcgttcacgggcgcggtgcgtgtattcgaatgcgaagaagactgcatggcggttgtcgcggcgcgcgactaccgcgaaggcgacgtgctcgtgatccgtaacgaagggccgaaaggcggtcccggtatgcgcgaaatgctgggtgtgacagcagcgatctacggtcagggcatgggcgagaaagtggcgttgttgaccgacggtcggttttcgggcgcgacacgtggcatgtgcatcggctatgtcggcccggaagcggcggcgggtggcccgatcggcctgttgcgcaatgacgaccgcgtgcatatcgacgcgcgcgcaggcattctgcgcgtcgacctgtccgacgacgaactcgcccgtcgccgcgccgacgcgccagcgcgcgcgtcgcgccggctcgcgggggtgctcgaaaaatacgaagcgttggtgcggcccgcgcatctcggcgcggtgacgcattcgggcaacgttgaatggccatacgacgaacccacgcccggcgacgacggagccgccgcatga

SEQ ID NO: 116 - protein, 588 aa, Burkholderia phytofirmans
MTNLHKHRSRRVTDGVTRAPHRAFLRATGLDDESMQKPFVAIVDTFGENTPCSMSLNQVSDNVRLGIAAGGGVPIRGSAISVSDGTSMNHSGMRMSLVSREVVADSVELFVRAHNYDALIGVAGCDKTLPGILMGMVRVNVPGVFLFGGAMLPGVAPGQLPGGAGTGLQRQSTILTTIEAVGTTQRGDMSRAQLDAIEKQCTPTAGSCPGQFTANTMAMVAETLGLAPLGSAMVPAVYSERIAIARRAGETVMRILTQGGPLPRDLVTMESLENACAAVAATGGSTNAALHIPAIANEAGIRFALDDVQRVFAKIPLIGDLQPGGRYLAQDLHHAGGVPAVLNALLAGGFLHGDVPAFGGGTLAEALSAFSGPDGIVVRPCDEPLGENGGLVILRGNLAPDGACLKIAGLKSLSFTGAVRVFECEEDCMAVVAARDYREGDVLVIRNEGPKGGPGMREMLGVTAAIYGQGMGEKVALLTDGRFSGATRGMCIGYVGPEAAAGGPIGLLRNDDRVHIDARAGILRVDLSDDELARRRADAPARASRRLAGVLEKYEALVRPAHLGAVTHSGNVEWPYDEPTPGDDGAAA

SEQ ID NO: 117 - DNA, 1713 bp, Bordetella petrii
atgtcactgcacaaacaccgctcgcggatggtcaccgacggcctgacccgggcgcctcaccgggcctttctgcgcgccaccgggttcgacgacgaagccctgaagaaatcaatcgttggcattgtcagtacccaaggcgaaaacacgccctgctcgatggccctggcgccccaggcggaccgcgcccgcctgggcgtggcggccgggggcggcgtgccggtcagtttttcgaccatttcggtgtcggatggcacgtccatgaaccatgccggcatgcgcatgagcctgctttcgcgcgaggcgatcgccgacagcgtggaaatggtgatgcgcggccacgcctatgacggactggtggcgttcgccggctgcgacaagacgctgcccgccatgatgatggcgatcgtgcgcctgaacgtgccggcggtgtttctctacggcggcgcgacgttgcccggccacgcgctcggcaagcaggccaccatcctggacaccatcgaggcagtgggccgcgtgcagcatggcggcatgacggccgccgagctcaagaccatggagcgtacttgcacgccatcggccggctcgtgcccgggccaattcaccgccaacaccatggccatggtcggagaagccctgggcttgtcgcccctgggcaccgccatgatgcccgcggtgtacagcgaacgcctggccatcgcccagcgggccggcgaacaagtcatgcgcgccctggcccaaggcggccccctgccgcgcgacctggtcacgcgcgccagcctggacaatgcctgcgccgcggtggctgccaccggcggctcgaccaacgcggcgctgcacattcccgccatcgctcacgaagccggcatccgctacacgctggatgacgttgccgccgtattccagcgcacgccattgatcgcggacttgcagccgggcggacgcttcctggcgcgcgacctgcacgaagcgggcggcgtgcccgccgtactgaaagccctgctggaaggcggttatatcgacggcaacgtgccgacgctcgacggccggccgctggcgcgagccctggtcgacttcgccgggccggacggcgaggtggtgcgcccctgctcgcgcgcgatccacccttcgggcggcgtcacggtgctgaaaggcaacctcagcccgcaaggcgcgctgctcaagatcgcgggcctgaaatcgctgcaattctccgggccggcgcgcgtgttcgaaaacgaagaagactgcatgcgcgcggtgtcacagcgcacctaccagcccggcgacgtgctggtcatccgcaacgaaggcccccagggcgggccgggcatgagagagatgctcagcgtgaccgccgcactgtatggacagggcatgggcgaaaaagtggccctgctgaccgacggccgcttctcgggcgcgacgcgcgggctgtgcatcggttatgtgggccccgaggccgcggcgggcggccccatcgccttcgttcgcgacggcgacatcatccatatcgacgcccaggccaataccttgcgcgtcgaactcagcgacgccgaactggccgcccgccgcgccagccatgtgccgccggcacggccgcgcctggccggcgcgctcgaaaaatacgccttgctggtgcggccggcgcacgaaggcgccgtcacgcactcggggggattggattggccctacgaaaccccggaggccgaatga

SEQ ID NO: 118 - protein, 570 aa, Bordetella petrii
MSLHKHRSRMVTDGLTRAPHRAFLRATGFDDEALKKSIVGIVSTQGENTPCSMALAPQADRARLGVAAGGGVPVSFSTISVSDGTSMNHAGMRMSLLSREAIADSVEMVMRGHAYDGLVAFAGCDKTLPAMMMAIVRLNVPAVFLYGGATLPGHALGKQATILDTIEAVGRVQHGGMTAAELKTMERTCTPSAGSCPGQFTANTMAMVGEALGLSPLGTAMMPAVYSERLAIAQRAGEQVMRALAQGGPLPRDLVTRASLDNACAAVAATGGSTNAALHIPAIAHEAGIRYTLDDVAAVFQRTPLIADLQPGGRFLARDLHEAGGVPAVLKALLEGGYIDGNVPTLDGRPLARALVDFAGPDGEVVRPCSRAIHPSGGVTVLKGNLSPQGALLKIAGLKSLQFSGPARVFENEEDCMRAVSQRTYQPGDVLVIRNEGPQGGPGMREMLSVTAALYGQGMGEKVALLTDGRFSGATRGLCIGYVGPEAAAGGPIAFVRDGDIIHIDAQANTLRVELSDAELAARRASHVPPARPRLAGALEKYALLVRPAHEGAVTHSGGLDWPYETPEAE

SEQ ID NO: 119 - DNA, 1713 bp, Bordetella bronchiseptica
atgtccctgcataagcaccgttcccgcatggttacccaaggcctgacgcgcaccccgcatcgcgccttcctgcgcgccaccggcttcgacgacgccgccctggagaaatccatggtcggcatcgtgagcacgcaaggcgagaacacgccctgctccatggcgctggggccgcaggccgaccgcgcccgcctgggcgtggccgccggcggcggcgtgccggtcagcttctcgaccatctcgatctccgacggcacctcgatgaaccatgcgggcatgcgcatgagcctgctgtcgcgcgagaccatcgccgacagcgtcgagctggtggtgcgcggccacgcctatgacgcactggtggcgttcgccggctgcgacaagacgctgccggccatgatgatggccatcgtgcggctgaacgtgccggcggtgttcctgtacggcggcgccaccctgcccggccatgcggccagcggccaggtcaccatcctcgacaccatcgaagccgtcggccgggtacagcacggcaccatgccggcggccgagctcaaggcgatggagcgcacctgtacgccctcggcgggctcgtgcccgggccagttcaccgccaacaccatggccatggtgggcgaggcgctgggcctgtcgccgctgggttcggcgatgatgcccgcggtctacagcgaacggctggccatcgcgcagcgcgccggcgagcacgtgatgcgcgccctggccgcgggcggcccgctgccgcgccagctggtgacgcgcgccagcctggagaacgcctgcgccgcggtggcggccaccggcggctcgaccaacgcggccctgcacattccggccatcgcgcacgaggccggcatcgccttcacgctggacgacgtggcccgggtgttcaagcgcacgccgctgatcgccgacctgcaacccggcggccgctatctggcgcgcgacctgcacgaggccggcggcgtgccggtggtgctcaaggcgctgctggacggcggccatatcgacggcagcgtgctgacgctcgacggccgcaccctggccgaggccctggccgacacgcccgcgcccgacggcaaggtggtgcgcgcctgcggccaggccctgcaccccaccggcggcgtcgccgtgctcaagggcaatctcagccccgatggcgcgctgctgaagatcgccggcctgaagtcgctgaaattctccgggccggcgcgcgtgttcgagaacgaggaagcctgcatgcgcgcggtgtccacgcacgcctaccagccgggcgaagtcctggtcatccgcaacgaaggcccccggggcgggccgggcatgcgcgagatgctcagcgtcacggccgccctgtatggacagggcatgggcgagaaagtggcgctgctgaccgacggccgcttctcgggcgccacgcgcggcctgtgcatcggctacgccgggccggaagcggccgccggcggccccatcgcgctgctgcgcgatggcgacatgatccacatcgacgccgaggccgatacgctggacgtggcgctgtccgacgaagagctggcgcggcgccgcgccgcctaccaggcgccgccgcaggcgcgcctggccggcgcgctggagaaatacgccgcgctggtgcgcccggcctgcctgggcgcggtcacccactccggccaggtcgattggccttacgaaacgccggaggccgaatga

SEQ ID NO: 120 - protein, 570 aa, Bordetella bronchiseptica
MSLHKHRSRMVTQGLTRTPHRAFLRATGFDDAALEKSMVGIVSTQGENTPCSMALGPQADRARLGVAAGGGVPVSFSTISISDGTSMNHAGMRMSLLSRETIADSVELVVRGHAYDALVAFAGCDKTLPAMMMAIVRLNVPAVFLYGGATLPGHAASGQVTILDTIEAVGRVQHGTMPAAELKAMERTCTPSAGSCPGQFTANTMAMVGEALGLSPLGSAMMPAVYSERLAIAQRAGEHVMRALAAGGPLPRQLVTRASLENACAAVAATGGSTNAALHIPAIAHEAGIAFTLDDVARVFKRTPLIADLQPGGRYLARDLHEAGGVPVVLKALLDGGHIDGSVLTLDGRTLAEALADTPAPDGKVVRACGQALHPTGGVAVLKGNLSPDGALLKIAGLKSLKFSGPARVFENEEACMRAVSTHAYQPGEVLVIRNEGPRGGPGMREMLSVTAALYGQGMGEKVALLTDGRFSGATRGLCIGYAGPEAAAGGPIALLRDGDMIHIDAEADTLDVALSDEELARRRAAYQAPPQARLAGALEKYAALVRPACLGAVTHSGQVDWPYETPEAE

SEQ ID NO: 121 - DNA, 1707 bp, Bradyrhizobium sp.
atgaggaagctgcgttcgcgcgtgacggtggaggggctcgaccgcgccccgcaccgcgccttcatgcgcgcgatgggcctcgatgacgccgacatcgccaagccgatgatcggaatcgtcagtcagaggggcgagcagacgccctgcaacatgacgcacgacttccaggtcgatgccgccaagaccggcatctccgagtccggcggcacgccgcgcgaattcgccaccgtctccgtctccgacggcatcagcatgaaccatgagggaatgaagttctctctgttctcccgcgagctgatcgccgattcgatcgaggccgtggtgcacggcctagcctatgacgcgctgatcggcttcggcggctgcgacaagaccttgcccggcgtgatgatgggtatggtccgctgcaacgtgccgtcgatcttcatctatggcggcagcgcgctgcccggcaagtaccagggcaagacgctcacggtgctcgactcctacgaagcggtcggcagctacatgaccggcgagatcgatgccgccacgctcgaaggcatcgagcgctcgtgcctgccgacgatcggcgcctgcgccggccagttcaccgcgaacaccatgggcatgctgtctgaggcgatgggcctgtcgatgcccaacgtctcgatgatccccggcgtctatgccgagcgcgcccatgtcgcgcgcgcagccgggcgcctgatcatgcagatgctcgccaacgatggcccgcggccgcgcgacatcgtcacccgcaaatccctggagaacggcgcggcgatcgtcgccgccaccggcggctcgaccaacgcggccctgcatctgcctgcgatcgcgaacgaggccggcatccgcttcacgctcgacgatgtcggcgaggtgttttcgcgcacgccgctgatcggcaatctcaggcccggcggcaagtatacggcgaaggacgtgtatgacatcggcggcgcggccgtcgtgatccgcgcgctgatcgacagcggccacatcgacggctcctgcatcacggtgaccggccgtacgctcgccgaggcctgcggcgcggccaatgcgccggatggcgaggtcgtgttcacgccggccaggccgatgatggccgacggcggcgtcgccgtgctcaagggcaatctcgcgccggatggtgcggtcatcaaggtcgccggtctcaagagcctggtgttcgagggccgcgcgcgcgtgtttgaagatgaagaagcctgcgtcgccgccgtccgcgcccgcaactaccaggcgggcgaggtgctgatcatccgtaacgaggggccggtcggcggccccggcatgcgcgagatgctcggcgtcaccgcgctgatctatggccagggcatgggcgagaaggtcgcgctgatcaccgacggccgcttctccggtgccacccgcggtttatgcatcggctacgtctcgccggaagccttcgtcggcggcccgctggcgctggtgcgtgatggcgatcccattcgcatcgatgcgaaagcgcgcacgctcgacgtgctgctcgacgagggcgagctcgccgcgcgtcgcagcgcgtggacgcagcggccgccgcggcatcgcgcgggagcgctggcgaaatacgcgaaactggtggggcaggcgccgctcggcgcggtcacgcatgagggaccggcggaatggccctggttcgatcaggagcaggaatga

SEQ ID NO: 122 - protein, 568 aa, Bradyrhizobium sp.
MRKLRSRVTVEGLDRAPHRAFMRAMGLDDADIAKPMIGIVSQRGEQTPCNMTHDFQVDAAKTGISESGGTPREFATVSVSDGISMNHEGMKFSLFSRELIADSIEAVVHGLAYDALIGFGGCDKTLPGVMMGMVRCNVPSIFIYGGSALPGKYQGKTLTVLDSYEAVGSYMTGEIDAATLEGIERSCLPTIGACAGQFTANTMGMLSEAMGLSMPNVSMIPGVYAERAHVARAAGRLIMQMLANDGPRPRDIVTRKSLENGAAIVAATGGSTNAALHLPAIANEAGIRFTLDDVGEVFSRTPLIGNLRPGGKYTAKDVYDIGGAAVVIRALIDSGHIDGSCITVTGRTLAEACGAANAPDGEVVFTPARPMMADGGVAVLKGNLAPDGAVIKVAGLKSLVFEGRARVFEDEEACVAAVRARNYQAGEVLIIRNEGPVGGPGMREMLGVTALIYGQGMGEKVALITDGRFSGATRGLCIGYVSPEAFVGGPLALVRDGDPIRIDAKARTLDVLLDEGELAARRSAWTQRPPRHRAGALAKYAKLVGQAPLGAVTHEGPAEWPWFDQEQE

SEQ ID NO: 123 - DNA, 1707 bp, Bradyrhizobium sp.
atgaggaagctgcgctcgcgcgtcacggtggaggggctcgatcgtgccccgcaccgcgccttcatgcgcgcgatggggctggatgatgccgacatcgccaagccgatgatcggcatcgtcagccagaagggcgagcagacgccctgcaacatgacgcacgacttccaggtcgacgccgccaagacgggcgtctccgaagccggtgggacgccgcgcgaattcgccaccatctcggtgtcggacggcatcagcatgaaccatgagggaatgaagttctctctgttctcgcgcgaactgatcgcggattcgatcgaggccgtggtccatggtctcgcttatgacgcgctgatcggctttggcggctgcgataagaccctgccgggcgtcatgatgggcatggttcgttgcaacgtgccgtcgatcttcatttatggcggcagcgctctgcctggcaagttccagggcaagacgctcacggtgctcgattcgtatgaagcggtcggcagctacatgaccggcgagatcgatgtcgcgacgctcgagggcatcgagcggtcgtgcctgcccaccatcggcgcctgcgccgggcagttcaccgccaacaccatgggcatgctgtccgaggcgatgggcctgtcgatgcccaacgtctcgatgatccccggcgtctatgccgagcgcgcccatgtcgcgcggcaggccggccggctgatcatgcagatgctggctcgtggtgggccgctgccacgcgatatcgtgacccgcaaggccctggagaacggtgcggcgatcgtcgccgccaccggcggctcgaccaatgccgcgctgcatctgccggcgatcgccaacgaagccggcatccgtttcacgctcgacgatgtcggcgaggtcttcgcccgcacgccgctgatcggcaatctccggccgggcgggaagtacaccgccaaggacgtctatgacatcggcggcgcggccgttgtgatccgcgcgctgatcgagagcggccatatcgacggctcctgcatgacggtgaccggccgcacgcttgccgaggactatggggccgccaatgcgcccgatggcgagatcgtgtttcatccggccagcccgatcatggcggagggcggcgtcgccgtgctcaagggcaatctggcgcctgacggcgcggtcatcaaggtggccggcctgaagaacctcgtattcgaggggcgggcccgcgtattcgaggatgaggaagcctgcgtcgccgccgtccgcgcgcgcaactatcaggcgggcgaggtactgatcatccgcaacgaggggccggtcggcggtcccggcatgcgcgaaatgctcggtgtgaccgcactgatctacggtcagggcatgggcgagaaggtggcgctgatcaccgacggccgcttctccggagcgacgcgcggcatgtgcattggctatgtctcgccggaagccttcgtcggcggtccgttggcgctgctgcgcgacggcgatccgattcgcatcgatgcaaaagcgcgcacgctcgacgtcctgctcgacgacgccgagctcgcggcccgtcgcgccgcgtggtcgcagcggccgccacggcatcgcgccggcgcgctggcgaaatatgccaagctcgtcggccaggcaccgctcggcgccgtgacgcatgaaggacccgcggactggccgtggttcgatcaggagcagaaatga

SEQ ID NO: 124 - protein, 568 aa, Bradyrhizobium sp.
MRKLRSRVTVEGLDRAPHRAFMRAMGLDDADIAKPMIGIVSQKGEQTPCNMTHDFQVDAAKTGVSEAGGTPREFATISVSDGISMNHEGMKFSLFSRELIADSIEAVVHGLAYDALIGFGGCDKTLPGVMMGMVRCNVPSIFIYGGSALPGKFQGKTLTVLDSYEAVGSYMTGEIDVATLEGIERSCLPTIGACAGQFTANTMGMLSEAMGLSMPNVSMIPGVYAERAHVARQAGRLIMQMLARGGPLPRDIVTRKALENGAAIVAATGGSTNAALHLPAIANEAGIRFTLDDVGEVFARTPLIGNLRPGGKYTAKDVYDIGGAAVVIRALIESGHIDGSCMTVTGRTLAEDYGAANAPDGEIVFHPASPIMAEGGVAVLKGNLAPDGAVIKVAGLKNLVFEGRARVFEDEEACVAAVRARNYQAGEVLIIRNEGPVGGPGMREMLGVTALIYGQGMGEKVALITDGRFSGATRGMCIGYVSPEAFVGGPLALLRDGDPIRIDAKARTLDVLLDDAELAARRAAWSQRPPRHRAGALAKYAKLVGQAPLGAVTHEGPADWPWFDQEQK

SEQ ID NO: 125 - DNA, 1749 bp, Bradyrhizobium japonicum
atgaagttgcgatgtcccgccgcgtacgggacatcgcacgtagatgatgcaaatatgaagaagttgcgatcacggataacgacagacggcctcgaccgggccccgcaccgcgcattcatgcgcgcaatggggctggacgatgcggcaatcgccaagcccatggtaggcattgtcagcatgaagggcgagcagacgccctgcaacatgacccacgacttccaggtggccgcggccaagacaggtattgaggaggccggcggcacgccgcgcgaattctcgaccgtgtcggtctctgacgggatcagcatgaatcacgagggaatgaagttctccctcttttcgcgcgagctgatcgccgactcgatcgaggctgtcgttcatggtctcgcctatgacgcgttgatcggatacggcggatgcgacaagacgcttcccggcgtgatgatgggcatggttcgttgcaacgtgccgtcgattttcatctacggcggcagttcgctgccggggcgcgtggacggacgaacgctgacagtgctcgactcctacgaggctgtcggcagcttcatgaccggagagatcgatagcgccacactggagcggatcgagcgcgcctgcctgccgaccatcggtgcgtgcgcgggccagtttactgcgaacaccatgggaatggtgtcggaggcgatggggctcaccattcccaacgtctcgatggtgcccggtgtctacgccgagcgcgcgcagatctcgcgacgcgccgggcggctgatcatggaaatgctggaacgcggtgggccgctgccacgggacatcgtgacgcggaaatccctcgagaacggggcggcgatcgtcgccgctacgggcggctcgaccaacgccgcgctgcatctgcccgccatcgcgaacgaggccggcatcgcattcacgatcgacgatgtcggcgaggtctttgccaggacgccgctgatcggaaatctgcggcccggaggcaaatacacggcgaaggatgtccacgacataggtggcgccgccgtggtgatccaggagttgatcagaaccggtcatatcgacggtaactgcatcaccatcaccggccggacgcttgccgaagaatatggcgcggccaacgcgccggacggtgaggtcgtttacgcggcaagtgcgccgatcatgccggatggcggtgtcgcggtgctgaagggcaacctctgtccggacggtgcggtcatcaaggtcgcaggtttgaagagccagttcttcgagggtgtcgcgcgcgttttcgaagacgaggaggcttgcgtcgcagcggttcgcgaccgcagctacaaggcaggtgaggtcctggtgatccgcaacgaagggccggtcggcggccccggtatgcgcgagatgctcggcgtcaccgcgctgatctacgggcagggcatgggcgaaaaggtggccctgatcaccgacgggcggttctccggcgcgacccgcggcatgtgtatcggctacgtgtcccccgaagcattcgttggcggtccgttggccctcgttcgcgacggcgacaagatccggattgatgctacaaaccggcgtatggatatgctggtcgacgagccggagctcgcggcgcgccgacgtgattggaaaccacgcccgccgcgtcaccgcgcaggcgcgctcgcaaaatatgcgcgactggtcggccaggcgccgggcggagcggttacccatgaggggcccgcagaatggccctggttcgaatga

SEQ ID NO: 126 - protein, 582 aa, Bradyrhizobium japonicum
MKLRCPAAYGTSHVDDANMKKLRSRITTDGLDRAPHRAFMRAMGLDDAAIAKPMVGIVSMKGEQTPCNMTHDFQVAAAKTGIEEAGGTPREFSTVSVSDGISMNHEGMKFSLFSRELIADSIEAVVHGLAYDALIGYGGCDKTLPGVMMGMVRCNVPSIFIYGGSSLPGRVDGRTLTVLDSYEAVGSFMTGEIDSATLERIERACLPTIGACAGQFTANTMGMVSEAMGLTIPNVSMVPGVYAERAQISRRAGRLIMEMLERGGPLPRDIVTRKSLENGAAIVAATGGSTNAALHLPAIANEAGIAFTIDDVGEVFARTPLIGNLRPGGKYTAKDVHDIGGAAVVIQELIRTGHIDGNCITITGRTLAEEYGAANAPDGEVVYAASAPIMPDGGVAVLKGNLCPDGAVIKVAGLKSQFFEGVARVFEDEEACVAAVRDRSYKAGEVLVIRNEGPVGGPGMREMLGVTALIYGQGMGEKVALITDGRFSGATRGMCIGYVSPEAFVGGPLALVRDGDKIRIDATNRRMDMLVDEPELAARRRDWKPRPPRHRAGALAKYARLVGQAPGGAVTHEGPAEWPWFE

SEQ ID NO: 127 - DNA, 1686 bp, Sphingomonas wittichii
atggcgttgaaggacgggaagggcgagacgcttccctcgcggacgatcaccgacgggctcgaccgcgccccgcaccgcgccttcctgcgggcgatggggcatgacgacgtggcgatcggccagcccttcgcgggcatcgtctcgaccggggcgtcggtgacgccctgctcgatgtcgctggcgcctcaggccgaggcggcgaaggccgggctccaggcggcgggggtgacgccgttcgaattctcgacgatcaccgtcgccgacagcatgtcgatgaaccatgccgggatgcgtttcagcctggtctcgcgggagatcatcgccgattcgatcgaggcggtgacgcgggcgcatggctatgacgggctgatcggcttcgcggcctgcgacaagacgttgccgggcacgatgatggggatgatccgggtcaaccgcccgtcggtgttcgtctatggcggcgcggcgctgcccggccgctggcaggggcgcgacatcggcatcgtcgacgtctatgagggcgtcggccgggtctatgccggcgagatggacgaggccgagctgacgcgcctcgaaaaggcgggggtgccgaccgtcggctcctgcgccgggcagttcaccgccaacaccatggcgatggtcgccgagacgctgggcctggcgctgccgcgcagcgcgatgatgccggcggtggcgagcgagcgccgcgcgctggccgaggaatcgggccgcgtgctcggccggctgatccgcgagggcggcccgcgcccgcgcgacctcgtcacccgtcgcagcctcgaaaacgccgccgccaccgttgccgccaccggcggctcgaccaacgccgcgctgcacctgccggcgatcgcacatgaggcaggcatatccttcaccatggaggacatcgccgcgatcttcgaccgcaccccgctgctcgccgacctcaagcccggcggccgcttctgggcgcgcgacctgcacgaggtcggcggcgtgccgaccgtgctgcgggcgatgctggaggcgggcgtgctgcacggcgactgcccgaccatcaccggccggacgatcggcgagatcgccgccgccgcgcccgcgccggacggggaggtggtgcgccccgccgaccggccgatcgcgccgaccggcggggtgatcgtgctgcgcggcagcctcgcccccgacggcgcgatgctcaaggtcgccgggctcaagcgcctgtcgcacgaagggccggcgcgggtgttcgacggcgaggaggcggcggtcgacgcggtccgccggcaggattaccagccgggcgacgtcatcgtcatccgtggcgaggggccgaagggcggccccggcatgcgtgagatgctgggcgtcaccgcgctgatctacggccagggcatgggcgaacaggtcgcgctgctcaccgacggccgcttctcgggcgcgacgcgcggcatgtgcatcggccatgtcggcccggaggcctcggccggcggcccgctcgcgctggtccgggacggcgatcgcatccgcatcgacgcgggccagcgcacgctcgacctgctcgtcgatgccgccgagctggagcgccgccgcgcggcctggaccgcgccggaggctaccgtcacctcgccgaccttgcgcaaatatgcgcggctcgtcgggccggcgcatctcggcgccgtcacccactga

SEQ ID NO: 128 - protein, 561 aa, Sphingomonas wittichii
MALKDGKGETLPSRTITDGLDRAPHRAFLRAMGHDDVAIGQPFAGIVSTGASVTPCSMSLAPQAEAAKAGLQAAGVTPFEFSTITVADSMSMNHAGMRFSLVSREIIADSIEAVTRAHGYDGLIGFAACDKTLPGTMMGMIRVNRPSVFVYGGAALPGRWQGRDIGIVDVYEGVGRVYAGEMDEAELTRLEKAGVPTVGSCAGQFTANTMAMVAETLGLALPRSAMMPAVASERRALAEESGRVLGRLIREGGPRPRDLVTRRSLENAAATVAATGGSTNAALHLPAIAHEAGISFTMEDIAAIFDRTPLLADLKPGGRFWARDLHEVGGVPTVLRAMLEAGVLHGDCPTITGRTIGEIAAAAPAPDGEVVRPADRPIAPTGGVIVLRGSLAPDGAMLKVAGLKRLSHEGPARVFDGEEAAVDAVRRQDYQPGDVIVIRGEGPKGGPGMREMLGVTALIYGQGMGEQVALLTDGRFSGATRGMCIGHVGPEASAGGPLALVRDGDRIRIDAGQRTLDLLVDAAELERRRAAWTAPEATVTSPTLRKYARLVGPAHLGAVTH

SEQ ID NO: 129 - DNA, 1683 bp, Rhodobacterales bacterium
atgaccaaacgcgacacgctcatctcacgcaccatcgtggaggggctcgaccgtgcgccccaccgcgccttcctgcgcgcgatggggcacgacgacacggcactggccagcccgttcgtcggcatcgcacataccgcgagcgaggtgacgccctgcaccatgtcgctcccgccgcagatccagtcggccaagttaggcatcacccgcgaaggaatgaccccgttcgaattcggcacgatcaccgtggccgacagcatgtcgatgaaccatcgcgggatgcgcttttcgctcgtctcgcgtgagatcatcgcggacagcatcgacgcagtggtgcgcggccatgcctatgacgggctgatgaccttcgcctcctgcgacaagacgctgccgggcatgttgatggccatcgcgcgcatcaaccgcccttcggtctttctgtatggcggggccgcgctgccgacgccgtggaacgggcaggacatcggggtggtcgacgtctacgaaggcgtggggcgcgtctatgaggggacatcgagcgaggaagagctcgacgcgatggaacgggtgggcgtgcccactgtcggctcctgcgccgggcagttcacggccaacaccatggcgctcgtggccgaggttctgggcttggcccccctcggtgtcgcctaccttcccgccgtctattccgaacggcaggcactggtgaaacgcgcggcgggtctgttgcgccgcgcggtggacgagaacggcccgctgccctcggacctcatcacgcgcgagtcgctggaaaacgccgtggtcgctgtgggcgcgacgggcgggtcgaccaatgccctcctgcacctgcccgcaatcgcgaacgaggtcgggatcagcttcacgctggacgacatcgcgaaggtgcttgaggacgtgccgctggtcgccgacctgaaacccggcggcgcctactgggcgcgcgacatgcaccacgtgggcagcaccccggcgctcctgcgcgtgttgaagggggcgggcgtgctgcacacggacacgccgagtgtcgagggccggacgctgggtgaactggccgacaccggacctgaagcggacggcaaggtgatccgagccgtgggcaatccggtcacgccgacctcaggcgtggtggtgctcaaggggtcgctcgcccccgaaggggcggtgctcaaggtcgcgggtctcaagcacacagttcacgaaggccccgcgcgggtgttcgagtgcgaggaggatgccgtggccgccgtgcgcaagcgcgaatacgaggcgggcgacgtgattgtgatccgcaacgaaggccccaagggcgggccggggatgcgcgagatgctgggcgtcaccgcgctcctctacggtcagggcatgggcgagaaggtcgcgctcatcaccgacggccgcttctcaggcgcgacgcggggtctgtgcatcggtcacgtcgggcccgaggcggcggcgggtggtcccatcggcctgatccgcaccggcgacatcatccagatcgacgcgggcaaacgggagttgaacgtcaaactatcgacagacgagcttgcccggcgcacccgccccccggtgcccgaggggctggaacccgaaacggcgaccctgcgcaaatacgcggctctcgtcggccccgcgcatctgggcgcgaccacgcaccggaacacctag

SEQ ID NO: 130 - protein, 560 aa, Rhodobacterales bacterium
MTKRDTLISRTIVEGLDRAPHRAFLRAMGHDDTALASPFVGIAHTASEVTPCTMSLPPQIQSAKLGITREGMTPFEFGTITVADSMSMNHRGMRFSLVSREIIADSIDAVVRGHAYDGLMTFASCDKTLPGMLMAIARINRPSVFLYGGAALPTPWNGQDIGVVDVYEGVGRVYEGTSSEEELDAMERVGVPTVGSCAGQFTANTMALVAEVLGLAPLGVAYLPAVYSERQALVKRAAGLLRRAVDENGPLPSDLITRESLENAVVAVGATGGSTNALLHLPAIANEVGISFTLDDIAKVLEDVPLVADLKPGGAYWARDMHHVGSTPALLRVLKGAGVLHTDTPSVEGRTLGELADTGPEADGKVIRAVGNPVTPTSGVVVLKGSLAPEGAVLKVAGLKHTVHEGPARVFECEEDAVAAVRKREYEAGDVIVIRNEGPKGGPGMREMLGVTALLYGQGMGEKVALITDGRFSGATRGLCIGHVGPEAAAGGPIGLIRTGDIIQIDAGKRELNVKLSTDELARRTRPPVPEGLEPETATLRKYAALVGPAHLGATTHRNT

SEQ ID NO: 131 - DNA, 1665 bp, Solibacter usitatus
atgaaactgcagagccataccatcactcagggacgagatcgcgccccggcgcgcgccatgttgaaagcgatcgggtttaccgatgaagatctggccaagccgatcatcgggatcgccaacacctggatcgagaccatgccgtgcaattacaacctgcgtgagctggccggcaaagtgaaggagggcatccgcgccgccggcgggacgccgatggagttcaacaccatcgcgatcagcgacggcgtcaccatgggcacggaaggcatgaaggcctcgctgatcagccgtgaagtaatcgcggattccatcgagctgatggtgcgcggccacatgttcgatggcatcgtcgccatggtggcctgtgacaagaccattcccggcgccgcgatggcgctgctccgcctcaacgtcccgggcgtggtgctttatggcggcaccatcatgccgggccgcttcgagggtcacgacatcacgattcaggacgtgtttgaagccgtcggcgcgcacgcgcgcggcaagatcaccgacgcgcaattgctcgacatcgaagaccacgcctgccccggcgccggagcctgcggcggacagttcacggccaacaccatggccaccgtgatggagctgatcggactctccccgatgggcacggctgccgttccccaggtggacaagcgcaaagacgcagtggcgtaccgctgcggcgaggttattctgaacgccgtgcgcaagaacattctgccgcgcgatatttgcacccgcaaagccttcgagaatgcgattgcaggcgtcgccggaacggccgggtccaccaacgccgtgctgcacctgctggccatggcgcgcgaagccgaagtgccgctgaccatcgatgagtttgaaccggtgctggcgcggacgccggtcttcgtcgatatcaaacccggcggaaagtacatggccgcggacgtggataaggccggcggcattccggtgatcgccaaccgcctgctcgagggcggctacgtggatggctcggcgatcacgatcaccggacgcaccttcgccgaagaagcgaacgaggccaaggaagtcgccgggcagccggtgattcttccgctcgccaaagcgctcaagccgcgcggcggtatcgcgattcttcgcggctctctggcgcccgaaggctgcgtgatcaagctggcaggccacgagaagaaatcgcaccacggtccggcgcgcgtgttcgagcgtgaggaagaggccatggcggccgtgcaggaaggcaagattcgcgagaacgacgtggtagtgatccgctacgaaggtccgcgcggcggccccggcatgcgcgagatgctgggcgtcaccggagccattgtcggcgccggtctgagcgatagcgtagcgctcttgaccgatggccgcttcagcggcgccacgcacggtttcatgatcgcgcacgtggcacccgaggcctttaacggcggcccgatcgcggtcgttcaggaaggcgacatgatcacggtggacgcaacccgcggcgtgcttgaattggatattcccgccggggaactgaagagccggctggccgcatggaagccccgcgaaccccgttacaagaaaggcgtgatcgcgaagtactgcaagctggtttcaagcgcgagcgaaggcgcgatcactcaagcatga

SEQ ID NO: 132 - protein, 554 aa, Solibacter usitatus
MKLQSHTITQGRDRAPARAMLKAIGFTDEDLAKPIIGIANTWIETMPCNYNLRELAGKVKEGIRAAGGTPMEFNTIAISDGVTMGTEGMKASLISREVIADSIELMVRGHMFDGIVAMVACDKTIPGAAMALLRLNVPGVVLYGGTIMPGRFEGHDITIQDVFEAVGAHARGKITDAQLLDIEDHACPGAGACGGQFTANTMATVMELIGLSPMGTAAVPQVDKRKDAVAYRCGEVILNAVRKNILPRDICTRKAFENAIAGVAGTAGSTNAVLHLLAMAREAEVPLTIDEFEPVLARTPVFVDIKPGGKYMAADVDKAGGIPVIANRLLEGGYVDGSAITITGRTFAEEANEAKEVAGQPVILPLAKALKPRGGIAILRGSLAPEGCVIKLAGHEKKSHHGPARVFEREEEAMAAVQEGKIRENDVVVIRYEGPRGGPGMREMLGVTGAIVGAGLSDSVALLTDGRFSGATHGFMIAHVAPEAFNGGPIAVVQEGDMITVDATRGVLELDIPAGELKSRLAAWKPREPRYKKGVIAKYCKLVSSASEGAITQA

SEQ ID NO: 133 - DNA, 1680 bp, Roseiflexus sp.
atgtctagcgacctcaaacgccgcagtcgcaccattaccgatgggcgcacccgcgccggggcgcgcgccatgctcaaggcaatcggcttcaccgacgaagacctggcaaaaccgatcatcggcatcgccaatacctggatcgagacgatgccatgcaacatcaacctgcgcgcgctggcggcgcgggtcaaggaaggcgtgcgcgccgccggcggcacgccgatggagttcaacaccgtcgctatcgccgatggcgtcaccatgggtacggaagggatgaaggcgtcgctgatcagccgcgacctgattgccgactcgatcgaactgatggggcgcgggtatatgttcgacgcgatcatcgcgctggtggcatgcgacaaaacgatccccggagcagcgatgggattgacgcgcctgaacatccccggcttcctgctctacggcggatcgattgctcccggtcactggcgcggcaaagagatcaccatccagcatgtgtacgaagcgatcggtgcagttgccgccggtaagatgaccgacgaagaactgaaagagatcgaagatgccgcgtgccccggtccgggagcatgcggaggtcagtacactgccaacacgatggcaaccgtgatggaaattatcggtctctcgccgatggggacggctgcggtgccggctgccgacccgcgcaaagattcggttggataccgcgccgggcagttgattatggatgtgctgcgacgcgatctgaagccgcgcgatattctgacacgggcggcattcgagaatgcgatcgccagcgtggcgttgaccggcggctcgaccaacgcggtactccatctgctggcgctggcgcgtgaggcgggcgtgccgctaacgctcgacgatttcgacgcgatcagtcgtcgtacaccgctctgctgcgacctgatgccgagcgggaagtactctgccattcacgtcgatcaggcgggcggcattcaggtgattgcgagacgcctggtcgacggcggtttcgcgcacggcgatgcgatcaccgtcactggtcgcaccctggcggaagaggcggcggatgctgtcgaaacgccaggtcaggatgtgatccgtcccctcgataatccgatcaagccgacaggcgggttgctggtgctgcgcggcaatctggcgcccgaaggatcggtggtcaaactgttcggttatgagcgcacctaccaccgcggtccggcgcgcgtcttcgatggcgaagaggcggcaatggccgctatcgtcggcggtgaaattcgaccggacgatattgtgattattcgctatgaaggtccgcgcggcggtcctggcatgcgcgagatgctcggcgttacttccgcgattgtcggcgccggacttgggcagtcggtctcgctcattactgatggacgcttcagcggcgcgacgcgcggtgtgatgatcggacacgtggcgccggaggcggcgcgaggcggaccgcttgcgattgtgcaggagggggatgagatcgagatcaatctcgacgagcgccgtgttgatctgctgctgtcagaagaagagattgccgaccggttgctcgcctggcagccgccagcgccgcgttatgagtggggcgtgatggcgcgctacggtgcgctggtgtcgtcagcgtccgaaggcgccgtgctggtgacaccatga

SEQ ID NO: 134 - protein, 559 aa, Roseiflexus sp.
MSSDLKRRSRTITDGRTRAGARAMLKAIGFTDEDLAKPIIGIANTWIETMPCNINLRALAARVKEGVRAAGGTPMEFNTVAIADGVTMGTEGMKASLISRDLIADSIELMGRGYMFDAIIALVACDKTIPGAAMGLTRLNIPGFLLYGGSIAPGHWRGKEITIQHVYEAIGAVAAGKMTDEELKEIEDAACPGPGACGGQYTANTMATVMEIIGLSPMGTAAVPAADPRKDSVGYRAGQLIMDVLRRDLKPRDILTRAAFENAIASVALTGGSTNAVLHLLALAREAGVPLTLDDFDAISRRTPLCCDLMPSGKYSAIHVDQAGGIQVIARRLVDGGFAHGDAITVTGRTLAEEAADAVETPGQDVIRPLDNPIKPTGGLLVLRGNLAPEGSVVKLFGYERTYHRGPARVFDGEEAAMAAIVGGEIRPDDIVIIRYEGPRGGPGMREMLGVTSAIVGAGLGQSVSLITDGRFSGATRGVMIGHVAPEAARGGPLAIVQEGDEIEINLDERRVDLLLSEEEIADRLLAWQPPAPRYEWGVMARYGALVSSASEGAVLVTP

SEQ ID NO: 135 - DNA, 1701 bp, Rubrobacter xylanophilus
atgcagaccacggacctcaggcgcaagagccgcatcatgttcgaggggcgggaccgggcccccgcccgctcctaccttctgggcatgggctacactcgggaggacctcgagaagcccatcgtgggggtggcccactcctggatcgagaccatgccctgcaactacaaccaccgccggctggccgagaaggtcaaggagggcatccgggcggccgggggcacccccatggagctgaacaccatcgcgatctccgacgggatcacgatgggcacccaggggatgaagacctccctggtctcgcgcgaggtgatcgccgactccatcgagctggtggggcgcggccacatgttcgacgccatggtgatcctggtcggctgcgacaagaccatccccgccggggcgatggcgctggcccggctggacgtccccggcatggtcatctactccggctccatagccccggggcgcttcaggggccgcgacgtgaccatccaggacgtcttcgagggggtgggcgcccacgccgcgggcaagatgagcgacgaggagctgcgggagctggaggagggggcctgcccgggcgcgggggcctgcggcggccagtacaccgccaacaccatggccatagcgctgcagtttttgggcctctcgccggtgggctccgccgacccgcccgccctggacggccgcaaggaggcggtctgcgaggaggcgggccggctggtgatgcgcctgctggagcgggacctcaagccctcggacatcctgagccgcgcggccttcgagaacgccatcgcctccgtggccgctaccgggggctccaccaacgcggtgctccacttcctcgccctcgcccaggaggcgggcatcccgctggacatagaggacttcgaccgggtcagctcccgcacccccatcatcgcggacctgaagcccggcggccgctttacggccgtggacatggaccgcgcagggggctcccggctgctgggcgcgcggatgctggaggcgaacctcgtggacggctcccagcccaccgtcaccgggcgcaccctggccgaggagttcgagggcgcgcgggagcgcccggggcaggaggtgatcctctccgccgagaggtccctcagcgagagcggcggcctggtgatcctcaagggcaacctggcccccgagggctgcgtggtgaaggtcgcgggctacacccgccgccgccacgagggtccggcgcgcgtcttcgactccgaggagcaggcgatggaggcggtccaggccggccggatctcggcgggcgacgtggtggtgatccgctacgaggggccgcgcggcggccccgggatgcgcgagatgctgggggtgaccgccgcgctggtgggccaggggctcggcgagagcgtggcgctgctaaccgacgggcgcttctcaggggccacccgcgggctcatggtgggccacgtcgccccggaggcggcccgcggcggccccatagccgccctgcgcgacggggaccgcatcacgatcgacgtcaccggcaggacgctgagcgtggcgctcaccggcgaggagctgcggaggcgcctggagaactggcgggagcccgagccgcgcttcaggctcggggtgatggccaagtacgccgccctcgtctcctcggcctccgagggggcggtgaccgtcccggactggcagcgccgcgccacctga

SEQ ID NO: 136 - protein, 566 aa, Rubrobacter xylanophilus
MQTTDLRRKSRIMFEGRDRAPARSYLLGMGYTREDLEKPIVGVAHSWIETMPCNYNHRRLAEKVKEGIRAAGGTPMELNTIAISDGITMGTQGMKTSLVSREVIADSIELVGRGHMFDAMVILVGCDKTIPAGAMALARLDVPGMVIYSGSIAPGRFRGRDVTIQDVFEGVGAHAAGKMSDEELRELEEGACPGAGACGGQYTANTMAIALQFLGLSPVGSADPPALDGRKEAVCEEAGRLVMRLLERDLKPSDILSRAAFENAIASVAATGGSTNAVLHFLALAQEAGIPLDIEDFDRVSSRTPIIADLKPGGRFTAVDMDRAGGSRLLGARMLEANLVDGSQPTVTGRTLAEEFEGARERPGQEVILSAERSLSESGGLVILKGNLAPEGCVVKVAGYTRRRHEGPARVFDSEEQAMEAVQAGRISAGDVVVIRYEGPRGGPGMREMLGVTAALVGQGLGESVALLTDGRFSGATRGLMVGHVAPEAARGGPIAALRDGDRITIDVTGRTLSVALTGEELRRRLENWREPEPRFRLGVMAKYAALVSSASEGAVTVPDWQRRAT

SEQ ID NO: 137 - DNA, 1779 bp, Salinispora tropica
gtgacgacccggcctaacccactcttcgtcggcatcgagcgcgccccagcgcgcgcctccatgcgcgccacaggtctgtcgaccgaggacctgaagaagccgatgatcggggtagcgcacagttggatcggcacgatgccgtgcaacctcaaccaccggcggctcgcccaggaggtgatggccggcgtgcgcgccgcaggtggcaccccgatcgagatcaacaccatcgcgatctcggacgtgatcaccatgggcacggagggaatgcggacctcactggtgagccgcgaggtgatcgccgactccatcgagttggtatgccgcggccacggtctcgacggcctggtgaccctggccggctgtgacaagaccatacccggtgcggcgctggcccacgtgcgactcgacatccccggagccgtcatctattccggcacgatgatgccgggcgagcacctcgggcgcgacatcaccctgcaggatgtgtttgaggccgtcggcagcgccaccgccaccggctgcaccgacgagctcgacaagctcgagcgcgcggcctgtcccggtatcggggcctgcgcgggccactacacggccaatacgatggccgtggtgctggagttcctcgggctttccccgttcggctcgatggatccgccggcagtcgacgcccgcaaggacacggtctgccgccaggccggcgagctggtcatgcgggcggtggcagaagggctgcggcccagccggttcctgacgccctcctcgttgcgcaacgccatcgccgccggggtcgccaccggcggctcgacgaacatggtgctccacctgttggcgatcgctcgggaggcgggcatcccgctggacattgacgagttcgaccggatcagctcggtgaccccgatcatcgctgacctgcgtccaaacgggacgtacaccgcggtggacctcgaccgggcgggcggcacccgggtgatcgcccgccacatggtcgacgcgggcctgattgctggcgacgaaagcaccgtcaccggccgcaccgtcgcacacgaggccgcggacgcggccgagacacccggccaacgggtcgtcaccacggtggaggcacccctatcgccttccggtgctctcctgatcttgcggggtaacctagcgcccgatggcagtgtggtgaaggcacccggcgcggtgaccctgcggatgaccggcaccgcattggtgttcaactgcgaggaggaagcgatggccgcggtccagactggccgcgtccggccaggccacgtcgtcgtcatccgctacgagggtccgcgcgggggtccagggatgagggaaatgctcggagtgacctcggcgctcatcggccgcggcctgggcacgtcggtcggtctggtgaccgacggccgtttctcgggcgcgaccaggggactgatggtggggcacgtcgctccggaggcggcggagggcggaccgatcgcggcggtgtgcgacggtgaccggatcaccatcgacctgcagcggcgcgaatgctctgtcgacctggatccgggcgaactggccgcgcggatgcgagactggtcggctccgccaccgcgctacacgatcggcgtcatggccaaatactggtcgacggtctcgtcggcggccgtgggcgccgtgacgaccccgcaccccacccagggcccggcgacagcgtcaggtaaggccgaggagtgccagcaggcgagtgcggtcgagggcgtgatggcggttggcggcggcgatgtcggtgctgccggcggttcgtag

SEQ ID NO: 138 - protein, 592 aa, Salinispora tropica
MTTRPNPLFVGIERAPARASMRATGLSTEDLKKPMIGVAHSWIGTMPCNLNHRRLAQEVMAGVRAAGGTPIEINTIAISDVITMGTEGMRTSLVSREVIADSIELVCRGHGLDGLVTLAGCDKTIPGAALAHVRLDIPGAVIYSGTMMPGEHLGRDITLQDVFEAVGSATATGCTDELDKLERAACPGIGACAGHYTANTMAVVLEFLGLSPFGSMDPPAVDARKDTVCRQAGELVMRAVAEGLRPSRFLTPSSLRNAIAAGVATGGSTNMVLHLLAIAREAGIPLDIDEFDRISSVTPIIADLRPNGTYTAVDLDRAGGTRVIARHMVDAGLIAGDESTVTGRTVAHEAADAAETPGQRVVTTVEAPLSPSGALLILRGNLAPDGSVVKAPGAVTLRMTGTALVFNCEEEAMAAVQTGRVRPGHVVVIRYEGPRGGPGMREMLGVTSALIGRGLGTSVGLVTDGRFSGATRGLMVGHVAPEAAEGGPIAAVCDGDRITIDLQRRECSVDLDPGELAARMRDWSAPPPRYTIGVMAKYWSTVSSAAVGAVTTPHPTQGPATASGKAEECQQASAVEGVMAVGGGDVGAAGGS

SEQ ID NO: 139 - DNA, 1722 bp, Acidobacteria bacterium
atgaccgaaaaatccccaaagccacacaagcgtagcgacgccattaccgaaggtcccaaccgcgccccagcccgcgccatgctgcgcgccgccgggttcaccccggaagaccttcgtaagcccatcatcggcatcgccaacacctggatcgaaatcggtccctgcaacctgcaccttcgtgagctcgccgagcacatcaagcagggcgttcgcgaagccggcggtacgccaatggagttcaacaccgtctccatttctgacggcatcaccatgggctcggaaggcatgaaggcgtcgctggtcagccgcgaggtcatcgccgactccatcgaactcgtcgcgcgcggcaatcttttcgacggcctgatcgccctatcgggatgcgataaaaccatccccgggaccatcatggcgctcgagcgcctcgacatcccgggtctcatgctctatggcggctccatcgcgcccggcaaattccatgctcagaaggtcacgattcaagacgtcttcgaggcagtcggtacgcatgcgcgcggcaaaatgagcgacgctgatctcgaagaactcgaacacaacgcctgtcccggcgccggcgcctgcggtggacaattcaccgctaacaccatgtccatgtgcggcgaattcctcggcatctcgccgatgggcgctaacagcgtcccggcgatgaccgtagagaagcagcaggtcgcacgacgctgcggacacctcgtcatggaactggtccgccgcgacatccgccccagccaaatcatcacgcgcaaggcgatcgaaaacgcaatcgccagcgtcgccgcctccggcgggtcgaccaacgccgttcttcacttgctcgccatcgcgcacgaaatggacgtcgaactgaacatcgaagacttcgacaagatcagttcgcgcacgccactgctctgcgaactcaagcccgctggccgcttcaccgccaccgatcttcatgatgccggcggtattccgctcgtcgcgcaacgcctgctcgaagcgaacctgctgcacgccgacgcactgactgtcaccggtaagaccatcgccgaagaagcgaagcaggcgaaagaaacgccgggccaggaagtggttcgtccgcttaccgatcccatcaaagctaccggcggcctcatgatcctgaaaggcaacctcgcatccgaaggctgcgtggtcaaactcgtcggacacaagaagctcttctttgaaggccccgctcgcgtcttcgagtcggaagaagaagcctttgcgggcgtggaagaccgcaccatccaggcgggcgaagtggtcgtggtccgatatgaaggcccgaagggcggccctggcatgcgcgaaatgcttggcgtgacggcggccatcgccggcaccgaactcgccgagaccgtcgcgctcatcaccgacggacgtttctccggcgctacccgcggcttgagcgtgggccacgttgcgcccgaagccgcgaatggcggcgcgatcgctgtggtacgcaatggcgacatcatcactctcgacgtggaacgccgcgaactgcgcgtccacctcaccgacgcagaactcgaagcgcgcctccgcaactggcgcgcgccggagccacgatacaagcgcggcgtcttcgccaagtatgcgagcaccgtttcgtcggcgtcgttcggggccgttaccggctccaccatcgaaaacaagaccttagccgggagtacgaagtag

SEQ ID NO: 140 - protein, 573 aa, Acidobacteria bacterium
MTEKSPKPHKRSDAITEGPNRAPARAMLRAAGFTPEDLRKPIIGIANTWIEIGPCNLHLRELAEHIKQGVREAGGTPMEFNTVSISDGITMGSEGMKASLVSREVIADSIELVARGNLFDGLIALSGCDKTIPGTIMALERLDIPGLMLYGGSIAPGKFHAQKVTIQDVFEAVGTHARGKMSDADLEELEHNACPGAGACGGQFTANTMSMCGEFLGISPMGANSVPAMTVEKQQVARRCGHLVMELVRRDIRPSQIITRKAIENAIASVAASGGSTNAVLHLLAIAHEMDVELNIEDFDKISSRTPLLCELKPAGRFTATDLHDAGGIPLVAQRLLEANLLHADALTVTGKTIAEEAKQAKETPGQEVVRPLTDPIKATGGLMILKGNLASEGCVVKLVGHKKLFFEGPARVFESEEEAFAGVEDRTIQAGEVVVVRYEGPKGGPGMREMLGVTAAIAGTELAETVALITDGRFSGATRGLSVGHVAPEAANGGAIAVVRNGDIITLDVERRELRVHLTDAELEARLRNWRAPEPRYKRGVFAKYASTVSSASFGAVTGSTIENKTLAGSTK

SEQ ID NO: 141 - DNA, 1668 bp, Thermus thermophilus
atgaggtcggaccagatcaagaagggactcaagcaggcccccgcccgcgccatgctccgggcggtgggggtgggggacgaggacttcggaaggcccttcgtgggggtggtgaacaccttcaccgacgggatgccctgcaacttccacctgcgggagctggcccagcacctcaaggccgggctcagggaggcggggcttttcccctttgagttcggggcccccgccatctccgacgggatcagcatgggcaccccgggcatgcgggcgagcctcgtaagccgcgaggtcatcgccgacagcgtggagctcatcgcccagggctacctctacgacggcatggtggggctttccgcctgcgacaagaccatcccgggcacggccatgggggtgatccgcagcggcgtccccggcatggtcctctacggggggacgatcgcccccggggagtggcaaggccggaagctcaccatcgtggaggtctttgaggcggtggggcaaagggccgcggggaagatcagcgaggaggagcttttggagattgaacgccgggccatccccggccccggggcctgtggggggcagtacaccgccaacaccatggccatggccctcgaggccctgggcctctcccccgtgggctacaacgccatccccgccgtccaccccgaaaaggagcgggccaccaaggaggcggggaaaatcctcgcctgggccatcgcccacgactggaagcccaaggacttcctcacccggaaaagcttcctcaacgccgtcgccgccgtggccgccacgggggggagcaccaacgccgtcctccacctcctcgccctggccaaggaggcgggggtggagctcagcctggacgactttgaccagatctcccgcaagaccccggtgatcgcggacctccgcccttggggcacctacaccgcctgggagctgtatgaagccggggggacggccctcgtcttcaagcggcttctggaggcggggctcctctttggggaggagaagaccctcacgggccgcaccctggcggaggaggtggagcgggcctaccgggaacaagaggggcagaaggtggtcttccccgtggagaaggccctcaagccccacggggggctcgtggtgctcaaggggaacctcgcccctcaaggcgccgtcctcaagctcgcggggacggaacgcacctcctttgagggcccggcccgggtctttgactccgaggaggcggccatggagaaggtcctgaagggggagatccggcccggggacgtggtggtcatccgctacgtgggccccaagggggcgccggggatgcccgagatgctctcggtgacgagcgccatcgtgggggagggcctggggccggaggtggccctcctcaccgacggccgcttctccgggggcacccgcggcctcatgatcggccacatcgcccccgaggccttcgtgggcgggcccatcgccctcctggaagagggggaccgcatccggattgacgtggaaggccgccgcctcgaggtcctcctccccgaggaggagctggaaaggcggagggcccgctggcggccccgaccccccgccttcacccacggcctcttcgcccgctacgccgccctggtgcgccaggcggacgagggggcggtgctggaagacccgctctag

SEQ ID NO: 142 - protein, 555 aa, Thermus thermophilus
MRSDQIKKGLKQAPARAMLRAVGVGDEDFGRPFVGVVNTFTDGMPCNFHLRELAQHLKAGLREAGLFPFEFGAPAISDGISMGTPGMRASLVSREVIADSVELIAQGYLYDGMVGLSACDKTIPGTAMGVIRSGVPGMVLYGGTIAPGEWQGRKLTIVEVFEAVGQRAAGKISEEELLEIERRAIPGPGACGGQYTANTMAMALEALGLSPVGYNAIPAVHPEKERATKEAGKILAWAIAHDWKPKDFLTRKSFLNAVAAVAATGGSTNAVLHLLALAKEAGVELSLDDFDQISRKTPVIADLRPWGTYTAWELYEAGGTALVFKRLLEAGLLFGEEKTLTGRTLAEEVERAYREQEGQKVVFPVEKALKPHGGLVVLKGNLAPQGAVLKLAGTERTSFEGPARVFDSEEAAMEKVLKGEIRPGDVVVIRYVGPKGAPGMPEMLSVTSAIVGEGLGPEVALLTDGRFSGGTRGLMIGHIAPEAFVGGPIALLEEGDRIRIDVEGRRLEVLLPEEELERRRARWRPRPPAFTHGLFARYAALVRQADEGAVLEDPL

SEQ ID NO: 143 - DNA, 1725 bp, Maricaulis maris
atgacccacgacagacgcaaatcttcagacgccatcacagccggcgcggcccgcgccccggcccgggccatgttgcgcgcgaccggcatgacggatggtgatttcgacaagccgatgatcggggtgatcaacacctggaccacggtcacgccctgcaacatgcacctggcggacctggccgcgccagtccgcgaagccgttcgtgaagccggtggccatccggtcgacttcaacacgatcgtcgtgtccgacgggatctcgatgggtaccgaaggcatgcgtgcctcgctgatctcgcgcgaggtgatcaccgactcgattgaactggcgacccggggtcacagcctggatggcgtcgttatcctcgtcggttgtgacaagaccattccggcggccgcgatggcgctggcccgcatggatgtgcccggttgcatcctctacggcggcacgatcatgccgggcaagctgggcgatcaggccctgtccatccaggacgtgttcgaagctgtaggcgcccatgccgcggggaccctggatgatgcaggcctggacaaggtcgaaaaagcggcttgcccgggcgccggcgcctgtggcggccagtttaccgccaatacgatggccatgatcctgaccatgctgggtctgtctccgatgggcgtgaacgacattcccgccccgcaccccgacaagccggaggcggcggctcgctgcggccgactggctgtcgagctggcgaaatccggcaccaccccgcgccgtttcatcaccgaagcctcccttcgcaatgccgttgtcggcgcttccgcctcgggcgggtcgaccaatgccgtcctgcacgtcgccgcaatcgccgccgaagccggcataccgttcgacattgccgagttcgaccgtatctccagcgaagcccccgtcatcaccgacctgaagccgggcgggcgttttctggcccaccacatgttcctggccggcggctcccgcctgttcggtcagcgcctgatcgagggcggcttgctggctgataccccgactgtctccggcaagagcctgcatgaagagtgcgccagcgccgaagagtcactcaatcaacgtgtcatccaatccgttgccaacccggtcaaaccggatggtggtttccgcgtcctgaccggcgacctggcccccgaaggcgcagtcctgaaactgtcgggtcatgcccgcagcgaattttccggaccggcccgggtgttcgaatgcgaggaagacgccttcgccgccgtggaggccaactcggtcaaggctggtgacatcatcatcatccgcaatgagggccccaagggcggccccggaatgcgggaaatgctgggcgtgaccgccgccctggtcggtcagggactggccggcgatgtcgccctgatcaccgatggccgcttttccggcgcctccaagggcttcgtgatcggtcatgtcagccccgaggccgccgatggcggtccgatcggacgggtccgaaatggagacagggtgcgcattgatgtcgccgcccgccggatcgatgtcgatgccgacctgtctgcccgtccgcaatcctcgtccggccggcccgccccgaccggtgttttcgccaaatatgccgcgctggtctcttcggcctcgcgcggcgccaccaccatcatcgcgccgactgccaccaaggcgtcgccgcaaacaaccgacatgcaatccaagcaggagatgcccgcatga

SEQ ID NO: 144 - protein, 574 aa, Maricaulis maris
MTHDRRKSSDAITAGAARAPARAMLRATGMTDGDFDKPMIGVINTWTTVTPCNMHLADLAAPVREAVREAGGHPVDFNTIVVSDGISMGTEGMRASLISREVITDSIELATRGHSLDGVVILVGCDKTIPAAAMALARMDVPGCILYGGTIMPGKLGDQALSIQDVFEAVGAHAAGTLDDAGLDKVEKAACPGAGACGGQFTANTMAMILTMLGLSPMGVNDIPAPHPDKPEAAARCGRLAVELAKSGTTPRRFITEASLRNAVVGASASGGSTNAVLHVAAIAAEAGIPFDIAEFDRISSEAPVITDLKPGGRFLAHHMFLAGGSRLFGQRLIEGGLLADTPTVSGKSLHEECASAEESLNQRVIQSVANPVKPDGGFRVLTGDLAPEGAVLKLSGHARSEFSGPARVFECEEDAFAAVEANSVKAGDIIIIRNEGPKGGPGMREMLGVTAALVGQGLAGDVALITDGRFSGASKGFVIGHVSPEAADGGPIGRVRNGDRVRIDVAARRIDVDADLSARPQSSSGRPAPTGVFAKYAALVSSASRGATTIIAPTATKASPQTTDMQSKQEMPA

SEQ ID NO: 145 - DNA, 1662 bp, Parvularcula bermudensis
atgacccaaaacaaacgaagcgacgccatcaccaagggaccggcccgggccgctgcccgcgccatgctccgcgcgacgggcatgtcggacgccgatttcgacaagccgatggtggggatcatcaacacctacgcctcggtcactccctgcaatatgcatttgcgcgccctgggcgaagacgtccgcgccggtgtcgttgaggggggcggctggccggtcgagttcgggaccatcgtcgtctccgacggcattacgatgggccacgaagggatgcgggccagcctgatgtcgagggaggtgatcgccgactccatcgaactagccgtgcgcggccacgcgctcgatgcggccatcgtgctggtgggatgcgacaagaccattccggccgcagcgatggccctggcacgactcgatatccccgggatcgttttctacggcggcacgatcgcccccggctgtcacaaaggccaggatatcagcattcaggatgccttcgaagctgtcggcgcctatggccttggccggatcgatggcgacgaattgtcggcggtggaacgcgcggcttgccctggtgccggggcgtgcggtggccagttcacggcgaacactatggcgatggccatggcgtttctcggccttgcccccatgggcgccggcgaccccccggccctccatccggacaaaacgatcgaggctcggcgctgtggccaattggtggccgagaatgcccttggcaccaccgcccgcacctatgtctcgcccgagagcctccacaatgccgtctgtgccgttgtcgcctccggcggctccaccaatgcggtgctgcacctcgccgctatcgccgcggaggcgaaggtccccttctcgatcgatctgttcgaccagctttcgaggaccacgccggtgatcgcgaacctcaaaccgggggggcgttacctggcgcaggatctgttcgccgtcgggggcaatcgccggttcggcaaaatgctgatggaagcgggcgcgctgaaagatattcccacgacgagcggacgctctctctttgccgagttggccgaggcgccgccgagcgatgacaccgacgtgctgcgccctgtggacgcgccgctcaagcccaccggcgggctgcgcatcctctatggcgacgtggcgcccgacggcgccgtgctgaaaaccgccggctatggcgacggcgcctttgaggggccggcgcggatcttcgaatgtgaggaggattgcttcgcggcggttcaggccggcaccattgccgagggcgatgtcgtcgtgatccgcaatgaaggccccaaaggcggcccggggatgcgagagatgctcggcgtcacagcggccctcgccggacagggccttgcaggaaaggtcgccttgttgaccgacggccgattttcaggcgccagtcatggcttcgttatcggtcacatctcccccgaggcggcggtgggcggccccatcggcctgttgcaggagggcgaccggatttcgatcgacgccgaagggcggcgtatcgatgccgccatcgactggcaggcccgcaaagagaattataccccaaccccaaaggcgccccagggcggctatttcgacaaatatcgcgcgttggtcggctcggcgagccgcggcgccacaactctccaggaaggataa

SEQ ID NO: 146 - protein, 553 aa, Parvularcula bermudensis
MTQNKRSDAITKGPARAAARAMLRATGMSDADFDKPMVGIINTYASVTPCNMHLRALGEDVRAGVVEGGGWPVEFGTIVVSDGITMGHEGMRASLMSREVIADSIELAVRGHALDAAIVLVGCDKTIPAAAMALARLDIPGIVFYGGTIAPGCHKGQDISIQDAFEAVGAYGLGRIDGDELSAVERAACPGAGACGGQFTANTMAMAMAFLGLAPMGAGDPPALHPDKTIEARRCGQLVAENALGTTARTYVSPESLHNAVCAVVASGGSTNAVLHLAAIAAEAKVPFSIDLFDQLSRTTPVIANLKPGGRYLAQDLFAVGGNRRFGKMLMEAGALKDIPTTSGRSLFAELAEAPPSDDTDVLRPVDAPLKPTGGLRILYGDVAPDGAVLKTAGYGDGAFEGPARIFECEEDCFAAVQAGTIAEGDVVVIRNEGPKGGPGMREMLGVTAALAGQGLAGKVALLTDGRFSGASHGFVIGHISPEAAVGGPIGLLQEGDRISIDAEGRRIDAAIDWQARKENYTPTPKAPQGGYFDKYRALVGSASRGATTLQEG

SEQ ID NO: 147 - DNA, 1683 bp, Oceanicaulis alexandrii
atgaccgataacaaacgcccctcgcacacactgatccaggggccggcccgcgccccggctcgcgccatgcttcgcgcggccggctatgacgatgaccggatggcgaaacccatgatcgccatcgtcaacacctggaccagcgtcaccccgtgcaacatgcaccttcagggtctcgccgatcatgcccgcgccgggatcgaggcggcaggcggcacggcggtggatttcaacaccatcgtcgtcaccgacggcatctccatgggcaccgaaggcatgcgcgccagcctgatgagccgcgattgcgtggcggactccgccgaactcgccgtgcgcggccattgcctggacgccgtgctgttcctggtgggctgcgacaagaccctgcctggcgccgccatggcggcggcgcggctgaacctgcccagcgtcgtgctctatggcggctcgatcatgccgggcaagctgggcgacaaggcggtgacgattcaggacgtgttcgaggccgtcggggcctgcgcggcgggcaagatcagcgaagacgaactcgtcgaagtcgaaaaagccgcctgccccggcgcgggcgcctgcggcggccagttcaccgccaacaccatggcgctggcgctgaccgcgctcggcctgtcgcccatggggctcaacgacattcccgccgttcatcccgacaagcccgaagccgcgcgcaaggccggtcaggccgtggtcgatgcgctgaaggcggatcgcaagccgcgcgacatcatcaccccgacctctctgaaaaacgccgccgtcgcggtgaccgccacggcgggctccacaaacgcggtcctgcatcttctggccattgcccgcgaagccggggtcagccgggatcagttcgacattgatgtgtttgacgccgtgagccggaagactccggtgatcgccgatctcaagcccggcggtcgctatatggcgccggacatggcggctgcgggcggggcacgcctgctgctgcagcgcctgaaagccgcggacatgctggacgatgcgcccaccgtcaccggcaagaccctgtttgaagaagccgagctggccgctgaaacgccgggtcaggacgtgatcctgtcgcccgacaaaccgctcaagaagcgcggcggcttcggcgtgctttatggcgatctcgccccggaaggctgcgtcgccaagctcgcgggtcatgaccgtctgttctttgaaggccccgccaaggtatttgattgcgaggaagactgcttcgccgcggtcaattcgggcgggatcgagaagggcaatgtggtcgtcatccgcaatgaaggccccgccggcgggccgggcatgcgtgaaatgctggccgtcaccgccgccattcaaggcgcaggcctgggcgatgatgtggcgttgatgacggacggccgcttctcgggcgcgacctatggcttcatggtcgggcacgtcgcccccgaagccgcccatggcggacccatcgcctttgtgaagaccggcgatatcatcaccatcgatatcgagaaccgtcgcattgatgtgaaggccgatctcaaggcgcgcatggcccagggcttcaccccgcccgaacccaaataccgcacgggggcgttcgcgaaatacgccaggctcgtccactccgcatcagatggcgcggtgacgagcttcccgttcgactag

SEQ ID NO: 148 - protein, 560 aa, Oceanicaulis alexandrii
MTDNKRPSHTLIQGPARAPARAMLRAAGYDDDRMAKPMIAIVNTWTSVTPCNMHLQGLADHARAGIEAAGGTAVDFNTIVVTDGISMGTEGMRASLMSRDCVADSAELAVRGHCLDAVLFLVGCDKTLPGAAMAAARLNLPSVVLYGGSIMPGKLGDKAVTIQDVFEAVGACAAGKISEDELVEVEKAACPGAGACGGQFTANTMALALTALGLSPMGLNDIPAVHPDKPEAARKAGQAVVDALKADRKPRDIITPTSLKNAAVAVTATAGSTNAVLHLLAIAREAGVSRDQFDIDVFDAVSRKTPVIADLKPGGRYMAPDMAAAGGARLLLQRLKAADMLDDAPTVTGKTLFEEAELAAETPGQDVILSPDKPLKKRGGFGVLYGDLAPEGCVAKLAGHDRLFFEGPAKVFDCEEDCFAAVNSGGIEKGNVVVIRNEGPAGGPGMREMLAVTAAIQGAGLGDDVALMTDGRFSGATYGFMVGHVAPEAAHGGPIAFVKTGDIITIDIENRRIDVKADLKARMAQGFTPPEPKYRTGAFAKYARLVHSASDGAVTSFPFD

SEQ ID NO: 149 - DNA, 1605 bp, Plesiocystis pacifica
atgctgcgcgccacgggcctcgaagacgaggacctcgccaagccgctgatcgccgtggtcaacacctggagcgacgtgaccccctgcaacgtgcacctgcgcgggctcggggaggcggtccgccgcggggtccaagacgctggcggaacgcccttcgagttcaacaccatcgtcgtcagcgacggcatctccatgggcacggagggcatgcgggcgtcgctggtctcgcgggaggtcatcgccgacagcatcgagctcgccgtgcgcgggcacagcctggacgcggtcgtggtcatcgtgggctgcgacaagacgatcccggcggcggccatggccctcgcgcgcctcgatcgtccggggctggtcctctatggcggctcgatcgccaagggccggcaccggggggccgacgtcagcattcaggaggtcttcgaggccgtgggcgcctgcgcggccgggcgcatcgacgcggacgagctcgacgccatcgagcgcagcgcgtgcccgggcgcgggggcctgcgggggccagttcacggccaacaccatggcccaggtgctgaccttgctcgggctctcgcccctgggcgcgaacgacattccggccacgcacccggccaagctcgaggtcgccgaggcttgcgggcgtcaggtcctcgagctgctcgagcgcgagctccggccgagcagcttgctgaaccgggcggccttcgcccgggcgacggcgggggtggccgcgagcaagggctcgaccaacgccgtgctccacatcctcgccatcgcccgggaggccggctgcgacttctcgttgcgcgagctcgacgaggtctgcgcggcgacccccgtgctctgcgacctcaagccctcggggcgctacctggccgtcgacatgagcgaggccggcgggacggccctgctcgcccggcggctgttcgaggccgggctgtgcgaggacggggcgagcgtcgacgggccctcgctccgggccctggtcgccgacgcccccgagcgcgaggggcagcgggtgatccggccggcgagccaggccttcgcgccccggggcgggctcatggcgctgttcggcaacctggcgcccgagggctgcgtgctcaagctgccccccgagctccccgaggtgttcgagggggtcgccagggtgttcgacgacgaggactcggccttcgccgcggtgcaggccggcgccgtcgaggccggcgacgtcgtcgcgatccgctacgaggggccggccggcggcccgggcatgcgcgagatgttggcggtcacggctgccctcgtgggtcggggcctcggcgggcgcgtggcgttgatcaccgacgggcgcttttcgggggcgagccacgggctggtcatcggccacgtcgcccccgaggccgcccggggcggccccctggccaggctccgcgacggcgaccgcgtgcgcatcgacgtcgtcggccagcgcctcgacgtgctcgacgcggacttcgaggcccggcgaagcccggccgcgaaggcgcctcgctacctcaccggcgccctcgccaagttcgccgcgctggtcgactcggccagcgaaggcgccacgacttctcgtccgcagttttga

SEQ ID NO: 150 - protein, 534 aa, Plesiocystis pacifica
MLRATGLEDEDLAKPLIAVVNTWSDVTPCNVHLRGLGEAVRRGVQDAGGTPFEFNTIVVSDGISMGTEGMRASLVSREVIADSIELAVRGHSLDAVVVIVGCDKTIPAAAMALARLDRPGLVLYGGSIAKGRHRGADVSIQEVFEAVGACAAGRIDADELDAIERSACPGAGACGGQFTANTMAQVLTLLGLSPLGANDIPATHPAKLEVAEACGRQVLELLERELRPSSLLNRAAFARATAGVAASKGSTNAVLHILAIAREAGCDFSLRELDEVCAATPVLCDLKPSGRYLAVDMSEAGGTALLARRLFEAGLCEDGASVDGPSLRALVADAPEREGQRVIRPASQAFAPRGGLMALFGNLAPEGCVLKLPPELPEVFEGVARVFDDEDSAFAAVQAGAVEAGDVVAIRYEGPAGGPGMREMLAVTAALVGRGLGGRVALITDGRFSGASHGLVIGHVAPEAARGGPLARLRDGDRVRIDVVGQRLDVLDADFEARRSPAAKAPRYLTGALAKFAALVDSASEGATTSRPQF

SEQ ID NO: 151 - DNA, 1713 bp, Bacillus sp.
ttgggaagagatcttagaataaaaagccatgtaatcagcgaggatgaaaggcgcgcaccaaaccgggcgatgctgcgggcagtagggttcacggatgaagatttcaaaaagccgatgatcggcattgcaagcacatggagcgaagtgactccgtgcaatatacatatcaatgaacttgcattcaaggcgaaggacggtgccagggaagccgggggagctccgcttgtattcaatacgattactgtttctgacggaatctccatgggaacagaggggatgaggtattcccttccgagccgcgacctgattgctgattccattgaaacggtcgttgggggtgaaagcctggacggctttgttgccattggaggctgcgataaaaatatgcccggctgcctgatggccatcgcaaggatgaacctgcctgctgtttttgtgtatgggggcacaatcaagcctggcaagctgcagggacaggatatcgatattgtgtcagtatttgaaggggtaggacagttcaatggtggggccattgataaagctggactcaatgagatcgaatgccatgcatgtccgggggccggctcctgcggcggaatgtacacagccaatacgatggcaagcgctatcgaggcgctgggaatgagccttccgggcagttcctccaatccggcagaaacagatgaaaagcggcaggattgccatgaagcaggaaaggcagtctaccgccttttggagcaggatatcaggccaagggatattcttacgaaggaagcgtttgagaatgcaattactgtcgtgatggctttgggcggttcgacaaatgccatcctccatttgatggccatcgcccattctgctgaagtggatctgtcacttgaggacttcaaccgccttcagaaaacggtcccccatatagccgatttaaagccgagcggaaaatatgtcatgcagaatctccatgaagcaggaggagtcagtgcagttatgaaaatgctgctgagggaagggctgcttcacggcgattgtctgactgtgacgggcaagacgctcgctgaaaatctggaagaagcagaagatctgaaagctggccaaaaggtcatttacccgcttaatgcccctcttcgggaaaacgggccgcttgtagtcctgaaaggcaatcttgccccggaaggcgccgtagcgaaggtatccggcctgaaggtcaccaggcacaccgggcctgccaaggtgtttgatgatgaggagtctgctacagatgctgtcctgaagggtgacattcaggctggtgatgtactggttatcaggtacgaagggccaaaaggcgggcctggcatgccggaaatgctttctatttcgggcatcctcgtaggaaaaggtcttggcgaaagtgtggccctgctgacagacgggcgtttctcgggaggtacccatggccttgtggtaggacatatcgctccggaagcacaggtcggcggaccgattgccctaatacagacaggtgacaggattactattgacagcaccgaacagacacttgaagtggatgtctctcctgctgaactggaagagaggaagaaatcctgggatccgccgccgcttttaacccgcggagccctggctaagtatacaaggctcgtttcctccgcttcaaggggggctgtcactgaccattttgaggaagagcctgctgccaggccgcttaaagtgtag

SEQ ID NO: 152 - protein, 570 aa, Bacillus sp.
MGRDLRIKSHVISEDERRAPNRAMLRAVGFTDEDFKKPMIGIASTWSEVTPCNIHINELAFKAKDGAREAGGAPLVFNTITVSDGISMGTEGMRYSLPSRDLIADSIETVVGGESLDGFVAIGGCDKNMPGCLMAIARMNLPAVFVYGGTIKPGKLQGQDIDIVSVFEGVGQFNGGAIDKAGLNEIECHACPGAGSCGGMYTANTMASAIEALGMSLPGSSSNPAETDEKRQDCHEAGKAVYRLLEQDIRPRDILTKEAFENAITVVMALGGSTNAILHLMAIAHSAEVDLSLEDFNRLQKTVPHIADLKPSGKYVMQNLHEAGGVSAVMKMLLREGLLHGDCLTVTGKTLAENLEEAEDLKAGQKVIYPLNAPLRENGPLVVLKGNLAPEGAVAKVSGLKVTRHTGPAKVFDDEESATDAVLKGDIQAGDVLVIRYEGPKGGPGMPEMLSISGILVGKGLGESVALLTDGRFSGGTHGLVVGHIAPEAQVGGPIALIQTGDRITIDSTEQTLEVDVSPAELEERKKSWDPPPLLTRGALAKYTRLVSSASRGAVTDHFEEEPAARPLKV

SEQ ID NO: 153 - DNA, 1686 bp, Oceanobacillus iheyensis
atgggaaaagatttgcggataaaaagtaaagcatttgacggtactatgcgagctccaaatagggcaatgcttcgtgcggtcggtctgacagatgaagattttaagaagcctatgattggtgtagcaagtacatgggcagaagtaacaccatgtaatatacatttaaatgatttagctcttcttgccaaaaaaggggtccggcactcggatgctgttcctttggtctttaatacgataaccgtatctgatggaatttccatgggaacacaaggtatgaactactcattgccgagtcgagatcttattgctgattcaatcgaaaccgttgttggagcagaaaatttagatggattagtagcaattggagcctgtgacaagaatattccagggtgcttgattgcgattgctaatgcaggagttccctcggtatttgtatatggcggaacaattgccccaggaaatgtggatgggaaagatatagatattgtttcagttttcgaaggagtaggacaacataatgcaggagctattgacgataatcaattaagaaaagtagaatgtaatgcttgtccaggtgcaggagcatgtggtggaatgtataccgccaatacaatggcctctgcagcggaagctttaggaatcagtttaccgggaagctcttctaacccagctgaatcagaagaaaagcagggtgatgtggaggcagctggtgaagcgattaaagatttattagagaaaggtatttatccaaaagatattctaacgaaaaaagcttttgaaaatgcaattacagtagttatggcattgggaggatctacaaatgcgatcttgcatttactagcagtttctcatgccgcagaagtagacttaacgattgatgattttaatcgaatccagaaaaaagtaccgcatttagccgatttaaaaccaagtggacgttttgtaatgcaagaccttcatcgagttggtggggtacaagcagtaatgaaattattgcatgaaaatggatacttacatggcgactgtcttactgtaacaggaaagactatagcagaaaatctagctgaagctcctgctttgaaagaaaatcaacaagtcattatgccgtttgataatccaaaaagggaagatggtcctctgattgtcttaaaggggaatttatcaccaactggtgctgtggcaaaagtatcaggggtgaaagtgaaacgacacacaggtcctgcacgtgtattcaacacagaaaaagaggcaactcaagcaattctggataacaaaattaaagagggagatgtattagttattcgttatgttggaccaaaaggtggtcccggaatgccggagatgttgtctgtttctagtattcttgtaggtaaaggaatgggagaatcggtagctttattgacggatggtagattctctggtggtacacatggtcttgtggtaggtcatataagtccagaggcacaagatggcggaccaattgcatttctgcaagaaggagatatggtgaccatagattctaataaaagagaaatttccatggacgtttcggaagatgaaataaaactacgtcaaggaaaatgggaagcccctgaactacataagaaaggggttcttggaaaatatgcacataatgttacttgctcatccaaaggtgcagtaacagattatttgaaccgagaataa

SEQ ID NO: 154 - protein, 561 aa, Oceanobacillus iheyensis
MGKDLRIKSKAFDGTMRAPNRAMLRAVGLTDEDFKKPMIGVASTWAEVTPCNIHLNDLALLAKKGVRHSDAVPLVFNTITVSDGISMGTQGMNYSLPSRDLIADSIETVVGAENLDGLVAIGACDKNIPGCLIAIANAGVPSVFVYGGTIAPGNVDGKDIDIVSVFEGVGQHNAGAIDDNQLRKVECNACPGAGACGGMYTANTMASAAEALGISLPGSSSNPAESEEKQGDVEAAGEAIKDLLEKGIYPKDILTKKAFENAITVVMALGGSTNAILHLLAVSHAAEVDLTIDDFNRIQKKVPHLADLKPSGRFVMQDLHRVGGVQAVMKLLHENGYLHGDCLTVTGKTIAENLAEAPALKENQQVIMPFDNPKREDGPLIVLKGNLSPTGAVAKVSGVKVKRHTGPARVFNTEKEATQAILDNKIKEGDVLVIRYVGPKGGPGMPEMLSVSSILVGKGMGESVALLTDGRFSGGTHGLVVGHISPEAQDGGPIAFLQEGDMVTIDSNKREISMDVSEDEIKLRQGKWEAPELHKKGVLGKYAHNVTCSSKGAVTDYLNRE

SEQ ID NO: 155 - DNA, 1695 bp, Staphylococcus saprophyticus
ttgactaaagaacacagcgaacaacaaaaagatttacgtattcgcagcaaagtaattagtgaaggtgtcagtcgtacacccaatcgagcttatttacgggcactcggctttgaagatgaagattttcaaaaaccaatgattggtgttgcaagtacttggagtgaagtcacgccatgtaatatgcatattgatggtttagctcgtgcttcaaaacaaggcattagtgaggcaggtgcttcgccacttattttcaataccattacagtatcagatggtatttcaatgggaacagacggtatgcgcttctctttaccaagtcgtgaaattatcgcggattctatagaatcagttgtcagtgctgaaaatttagatgcacttgtcgctattggtggttgtgacaaaaacatgccgggatgtatgattggtatcgctcgtcttaatttaccagctgtctttgtttatggcggcacaatattgcctgggaaattggatggtaaagatttagatgctgtttctgcctttgaaggcgtcggacagtataataatggcgaaatagataaagaggcacttcacaaagtagaatgtgccgcttgtccaggggccggtgcttgtggtggtatgttcactgccaatacgatgtcatctgctattgaggccatgggcatgagtttaccaggaagtgcttcgcatccagcagtttctacaaataaatccaaagacagcagagcagcaggtaaagccgtttataaactattagaaaaaggcatctatccaaaagatattatgactaaagaagcatttgaaaatgcaattactgtagtcatggcacttggaggatctaccaatgcaattttacatttacttgctattgcacatacaatcgaagtcgatttaacacttgatgatttcgaaaaaattcgtaagcgtgtcccacatatcgctgacttgagaccaagtggtaaatatgtcatggcacatcttgatgaagtcggtggtattccagcagttatgaaattattacatgacaaaggcttaatccatggagattgcttgaccgtaactggcaagactgttgctgaaaaccttgaacaacaacctgacctaaccgataataaatctatcattgattttgacaatccaaaacatgctactggaccgcttgttatcttgaaaggaaatcttgccccagaaggcgccgttgcaaaaatctcaggtctgagcgtaacttatatcaaaggacccgcacgcgtatttgattccgaatctaaggctaccaaagccatcttaaatgacgaaatcaaaccaggtgacgtggtcgttattcgatatgctggccctaaaggtgcacctggcatgcctgaaatgctatctgcatcatccattcttgtgggtaagggattaggtgaatctgtagcgttactcacagatggccgtttctctggcggttctcatggtcttgttatcggacacgcagcgccagaatcacaagttggcggtccgatggcattattagaagaaaacgacacgattaccattgacgcagaaaaacttgaaattagttttgatgtatcagacgaagaacttgagcgtcgtaacaaacaatggcaagcaccacctttaaaagccaatcgaggtacgctagctaagtatgctaagcttgtgtcatccgcttcaaaaggagctatcacagactaa

SEQ ID NO: 156 - protein, 564 aa, Staphylococcus saprophyticus
MTKEHSEQQKDLRIRSKVISEGVSRTPNRAYLRALGFEDEDFQKPMIGVASTWSEVTPCNMHIDGLARASKQGISEAGASPLIFNTITVSDGISMGTDGMRFSLPSREIIADSIESVVSAENLDALVAIGGCDKNMPGCMIGIARLNLPAVFVYGGTILPGKLDGKDLDAVSAFEGVGQYNNGEIDKEALHKVECAACPGAGACGGMFTANTMSSAIEAMGMSLPGSASHPAVSTNKSKDSRAAGKAVYKLLEKGIYPKDIMTKEAFENAITVVMALGGSTNAILHLLAIAHTIEVDLTLDDFEKIRKRVPHIADLRPSGKYVMAHLDEVGGIPAVMKLLHDKGLIHGDCLTVTGKTVAENLEQQPDLTDNKSIIDFDNPKHATGPLVILKGNLAPEGAVAKISGLSVTYIKGPARVFDSESKATKAILNDEIKPGDVVVIRYAGPKGAPGMPEMLSASSILVGKGLGESVALLTDGRFSGGSHGLVIGHAAPESQVGGPMALLEENDTITIDAEKLEISFDVSDEELERRNKQWQAPPLKANRGTLAKYAKLVSSASKGAITD

SEQ ID NO: 157 - DNA, 1752 bp, Bacillus selenitireducens
atgatagacgttatatggcatgtgagattatgtacattgacagaaagggtgaatgttgtgagtgagaaggatttgcgtcataaaagtaaagtgatcagtgaaggggtaaaccgggttccgaaccggtcaatgctgcgtgcagtcgggtttaccgatgaggatttcaagaaaccgatgattggggttgcgagtacgtggagtgaggtcaccccttgtaatgtacatattgatgccttggcaagagatgccaagctcggagcggcagaaggcggcggagcgccgatgatcttcaatacgatcatggtcgctgacgggattgcgatggggcatgaaggcatgagctattccctgccgtcaagggaagtcatcgccgattccattgaaacggttgtcggagcagaagccctcgacgccgtcgtcgccattggcggttgtgacaaaacaacgccgggctgtctcatttccatgggacggatgaatgtaccgggcgtctatgtgtatggcggtacgatcaaaccggggaaactcgatggcaaggacatcgacatcgtcaactccttcgaggcagtcggtcagtaccagagcggcaagcttgatgaggaaggccttcataaagtggaatgttctgcctgccctggaccgggttcctgcggcgggatgtacacggcaaatacaatggccgcagcggcagaagcgctcggcatgagtattccaggctcatcatcgacgcctgcagtggatgattataagcatcaggagtgcaggcaggccggcgatctgacggttcagcttttggaaaaagacatcaagccccgtgatattatgacgaagaaggcgtttgagaatgccattaccgtcgtcatggccctcggcggctcaacaaatgccttcctgcatcttcttgcgattgcgagaagcgttgacgtcgacttgacgtatgatgactttgaacgggtccgcaagaacgtcccgcatattgccgatctgaagccaagcggtcagtatgtcatggaagacctcttccaggcagggggcgtgcctggcgtgatgaagctgcttcttgaagccggcctcctacatggcgactgcatgacggtaactggcaagacgattgccgagaaccttgcagctgcggaaccgctgaaagaaggacaaaaagtgatttttccgcttgataagccgattaagccaagcggtccattgattgtcatgaaagggaatctggcccctgaaggcggggttgccaagatgagcggtcagtcgatcagtcattttgaaggtacgatcaaagtgtatgacagtgaggccgatgcgacgaaggccattgaagcgggagagatcgttgagggggatgtcctcgtcatccgctatgtgggtccaaaaggcggtccgggtatgccggagatgctctcgatcacggcgatgatcgtaggtcgaggcttgaacggtaaagtcgcactgatgacagatggccgattctccggcggttcacacggctttgttatcggtcatattgcaccggaagccgcagtaggcgggccgattgcgctgatcaagaatggtgacaaggtcacgatcgatgcggatacgcaggagatcaatctgcatattgatgaagcggagtttgagaagcggaaacaggaatggcagccgaagccgccgcggtttacgtacggcgtgttgaagaaatatgccaaactcgtttcgtcttcagcggaaggcgcaattacagacggtaaagaagccgattga

SEQ ID NO: 158 - protein, 583 aa, Bacillus selenitireducens
MIDVIWHVRLCTLTERVNVVSEKDLRHKSKVISEGVNRVPNRSMLRAVGFTDEDFKKPMIGVASTWSEVTPCNVHIDALARDAKLGAAEGGGAPMIFNTIMVADGIAMGHEGMSYSLPSREVIADSIETVVGAEALDAVVAIGGCDKTTPGCLISMGRMNVPGVYVYGGTIKPGKLDGKDIDIVNSFEAVGQYQSGKLDEEGLHKVECSACPGPGSCGGMYTANTMAAAAEALGMSIPGSSSTPAVDDYKHQECRQAGDLTVQLLEKDIKPRDIMTKKAFENAITVVMALGGSTNAFLHLLAIARSVDVDLTYDDFERVRKNVPHIADLKPSGQYVMEDLFQAGGVPGVMKLLLEAGLLHGDCMTVTGKTIAENLAAAEPLKEGQKVIFPLDKPIKPSGPLIVMKGNLAPEGGVAKMSGQSISHFEGTIKVYDSEADATKAIEAGEIVEGDVLVIRYVGPKGGPGMPEMLSITAMIVGRGLNGKVALMTDGRFSGGSHGFVIGHIAPEAAVGGPIALIKNGDKVTIDADTQEINLHIDEAEFEKRKQEWQPKPPRFTYGVLKKYAKLVSSSAEGAITDGKEAD

SEQ ID NO: 159 - DNA, 1704 bp, Streptococcus pneumoniae
atgactgaattagataaacgtcaccgcagtagcatttatgacagcatggttaaatcacctaaccgtgctatgcttcgtgcgactggtatgacagataaggactttgaaacaccgattgtgggagtgatttcgacttgggcggaaaatacaccatgtaacattcacttgcatgatttcgggaaactggctaaagaaggtgtcaaatctgcaggcgcttggcctgtacagtttggaaccattaccgtagcagacgggatcgctatgggaacgcctggtatgcgtttctctctaacatctcgtgacatcatcgcggactccatcgaggcggctatgagtggtcacaacgtggatgcctttgtcgctatcggtggctgtgacaagaacatgcctggatctatgattgctattgctaatatggatatcccagctattttcgcctatggtggaactattgcaccgggaaatcttgatggtaaagatatcgacttggtttctgtctttgaaggtatcggaaaatggaaccacggtgacatgacagctgaggacgtgaaacgtcttgaatgtaatgcctgccctggccctggtggctgtggtggtatgtatactgctaataccatggcaactgctatcgaagttctagggatgagtttgccagggtcatcctctcacccagctgaatcagctgataagaaagaagatatcgaagcagcaggacgtgctgttgttaagatgttggaacttggtctcaaaccatcagatatcttgactcgtgaagcctttgaagatgctattactgtaacgatggctctcggtggttctacaaacgccactcttcacttgctcgccattgcccatgccgcaaatgttgacttgtcacttgaggacttcaatacgattcaagaacgtgtgcctcacttggccgacttgaaaccatctggtcagtatgtcttccaagacctctacgaagtcggtggtgtccctgcggttatgaagtacttgttggcaaatggtttccttcacggagatcgcatcacatgtactggtaagactgtagctgaaaacttggctgactttgcagacttgactccaggccaaaaagttatcatgccacttgaaaatccaaaacgtgcggatggtccgcttatcatcttgaacgggaaccttgctcctgacggtgcagttgccaaggtatcaggtgttaaagtgcgtcgtcacgttgggccagctaaggtctttgactcagaagaagatgcgattcaggccgttctgacagatgaaatcgttgatggcgatgtagtcgttgttcgttttgttggacctaaaggtggtcctggtatgcctgagatgctgtcactttcttcaatgattgttggtaaaggtcagggagataaggtggccctcttgacggacggacgtttctctggtggtacttatggtctggttgttggacatatcgctcctgaagctcaggatggtggaccaattgcctatctccgtaccggcgatatcgttacggttgaccaagataccaaagaaatttccatggccgtatccgaagaagaacttgaaaaacgcaaggcagaaacaaccttgccaccactttacagccgtggtgtcctcggtaaatatgcccatatcgtatcatctgcttcacgcggagccgtgacagacttctggaatatggacaagtcaggtaaaaaataa

SEQ ID NO: 160 - protein, 567 aa, Streptococcus pneumoniae
MTELDKRHRSSIYDSMVKSPNRAMLRATGMTDKDFETPIVGVISTWAENTPCNIHLHDFGKLAKEGVKSAGAWPVQFGTITVADGIAMGTPGMRFSLTSRDIIADSIEAAMSGHNVDAFVAIGGCDKNMPGSMIAIANMDIPAIFAYGGTIAPGNLDGKDIDLVSVFEGIGKWNHGDMTAEDVKRLECNACPGPGGCGGMYTANTMATAIEVLGMSLPGSSSHPAESADKKEDIEAAGRAVVKMLELGLKPSDILTREAFEDAITVTMALGGSTNATLHLLAIAHAANVDLSLEDFNTIQERVPHLADLKPSGQYVFQDLYEVGGVPAVMKYLLANGFLHGDRITCTGKTVAENLADFADLTPGQKVIMPLENPKRADGPLIILNGNLAPDGAVAKVSGVKVRRHVGPAKVFDSEEDAIQAVLTDEIVDGDVVVVRFVGPKGGPGMPEMLSLSSMIVGKGQGDKVALLTDGRFSGGTYGLVVGHIAPEAQDGGPIAYLRTGDIVTVDQDTKEISMAVSEEELEKRKAETTLPPLYSRGVLGKYAHIVSSASRGAVTDFWNMDKSGKK

SEQ ID NO: 161 - DNA, 1719 bp, Streptococcus sanguinis
atgaaagggaaagctatgacagataaggatattcgtcacagaagtaagatttatgacagtatggttaaatctcctaaccgtgccatgcttcgcgcgacggggatgactgataaagattttgaaacgcctattgttggggtgatttccacttgggcggaaaatacaccctgtaacatccatttgcatgacttgggcaagctagccaaggaaggtatcaaagcagagggcgcttggcctgttcagtacgggactattacggttgcggacggaattgccatgggaacgccgggtatgcgcttctctctgacctcacgcgatatcatcgcagactccatcgaggctgccatgggcgggcataatgtggatgctttcgtagctatcgggggctgtgataaaaatatgccaggctccatgattgccattgccaatatggatattcctgctgtctttgcctacggcggaacgattgcgccagggaagctggacggtaaggacattgacttggtttctgtctttgaaggaatcgggaaatggaaccatggtgatttgacggctgaggaagtacgacgcattgagtgtaatgcctgccctggccctggtggctgtggtggtatgtatacggccaatactatggcgacggctattgaagttctgggtatgagcctgccaggctcctcttctcaccctgctgagtctaaagacaagcaagaggatatcgaagcagctggtcgtgctgttgtgaaaatgctgaaaatggggctgaagccgtctgacatcttgacacgtgaagcctttgaagatgcaatcacggtgaccatggctctgggtggttctactaatgctaccctgcacttgctggccatggcgcacgcggccaatgttgagctgacgcttgatgactttaatgtcattcaagagaaggtaccgcatttggctgacttgaaaccatctggtcagtatgtcttccaagacctttatgaggttggtggggtaccggctgtgatgaaatatctcttggcgaacggcttcctgcatggtgatcgcatcacttgtacaggtaagactgttgcagagaatctggtagaatttgctgatctgacaccaggtcaaaaggtcattatgccgcttgaaaatccaaaacgtgcggacggtccgctcattatcttgcatggtaatctggctccagatggtgctgttgccaaggtttctggtgttaaagtgcgccgtcacgttggaccggctaaggtctttgactcagaagaagcagctattgatgctgtactggccgatgaagtggtcgatggcgatgtggtcgtggttcgctatgttggaccaaagggtggccctggtatgccagaaatgctgtcactttcttctatcatcgtagggaaaggtcaaggggacaaggtggcacttctaactgacggccgcttctcaggcggtacttacggcttggttgtcggacacattgctccggaagctcaggatggtggcccgattgcctatcttcgtacaggcgatatggtcacggttgaccaagataccaaggaaatctctatggcagtctctgacgaagagctggcgaaacgtaaggcagaaacgactattccaccgctttatagtcgcggggtacttggtaaatatgctcacatggtatcgtctgccgctaaaggtgctgttactgacttctggaaaccagaagaaacaggtaagaaatag

SEQ ID NO: 162 - protein, 572 aa, Streptococcus sanguinis
MKGKAMTDKDIRHRSKIYDSMVKSPNRAMLRATGMTDKDFETPIVGVISTWAENTPCNIHLHDLGKLAKEGIKAEGAWPVQYGTITVADGIAMGTPGMRFSLTSRDIIADSIEAAMGGHNVDAFVAIGGCDKNMPGSMIAIANMDIPAVFAYGGTIAPGKLDGKDIDLVSVFEGIGKWNHGDLTAEEVRRIECNACPGPGGCGGMYTANTMATAIEVLGMSLPGSSSHPAESKDKQEDIEAAGRAVVKMLKMGLKPSDILTREAFEDAITVTMALGGSTNATLHLLAMAHAANVELTLDDFNVIQEKVPHLADLKPSGQYVFQDLYEVGGVPAVMKYLLANGFLHGDRITCTGKTVAENLVEFADLTPGQKVIMPLENPKRADGPLIILHGNLAPDGAVAKVSGVKVRRHVGPAKVFDSEEAAIDAVLADEVVDGDVVVVRYVGPKGGPGMPEMLSLSSIIVGKGQGDKVALLTDGRFSGGTYGLVVGHIAPEAQDGGPIAYLRTGDMVTVDQDTKEISMAVSDEELAKRKAETTIPPLYSRGVLGKYAHMVSSAAKGAVTDFWKPEETGKK

SEQ ID NO: 163 - DNA, 1719 bp, Streptococcus thermophilus
atggaggaaaacatcgtgtctgaaaataacatgaaacaccgttcttctgtctacgatagcatggttaaatcacctaaccgtgctatgcttcgtgcgactgggatgacggatgatagttttgaaaagcctattgttggggttatctcaacttgggctgagaacacgccatgtaatatccacttgcacggttttggtcaaattgccaaagagggtgtcaaagatgcgggtgcttggccagttcaatttggtacaattaccgttgcagatggtattgccatggggacaccagggatgcgtttctcattgacatctcgtgatattattgctgactcaatcgaagctgctatgggtggtcacaatgtcgatgcctttgttgctattggtggctgtgataagaacatgccaggttcaatgattgctattgccaacatggatattccagctatttttgcttacggtggtacgattgcaccgggtaatcttaacggtaaggatatcgacttggtttctgttttcgaaggtatcggtaaatggaaccacggagatatgactgccgaagaggttaaaaatcttgaatgtaatgcttgccctggccctggtggttgtggtggtatgtatactgctaacacaatggcaacagcaattgaggttatggggatgagccttccaggatcatcatctcaccctgcagaatcagctgagaagaaggctgatatcgaagaagcaggtcgtgcagttgtaaaaatgctagaaatgggacttaagccatcagatatcttgacacgtgaagcctttgaagatgccatcacagttacaatggcgcttggtggttcaacaaatgccactcttcacttgcttgctatcgctcatgcggctaacgttgatttaacgcttgaagacttcaacgatttccaagagcgcgtgcctcacttggctgacttgaagccttcaggtcaatatgtcttccaagacctttacaatgttggtggtgtgccagccgttatgaaatatcttcttaagaatggttttcttcacggtgatcgtatcacgtgtactggtaagactgttgcagaaaatttggaagctttcgatgatttgacaccaggtcaaaaagttatcatgccacttgaaaatcctaaacgtgccgatggtccattgattatcttgaaaggtaacttggccccagaaggtgctgttgccaaagtatcaggtgttaaagtgcgtaacattactggtcctgctaaagtatttgactcagaagaagatgccatcgaggcagttctttctgacgaaatcgttgacggcgatgtagttgttgtacgttttgtaggtcctaagggtggtcctggtatgccagaaatgttgtcattgtcatcaatgattgttggtaaaggacaaggagacaaggttgccctcttgactgatggacgtttctcaggtggtacttacggacttgttgtaggtcatattgctcctgaagctcaagttggtggaccgattgcctacctccgtacaggtgatatggttacagttgaccaggataccaaagaaatcactatgcatgtaccagacgaagagttggcgaaacgtaaagcagaaactgagttaccaccactttatagccgtggtgtcctcggtaagtatgctcacatcgtttcatcagcatcacgtggtgcggttactgacttctggaatatggataaatcaggtaaagcttaa

SEQ ID NO: 164 - protein, 572 aa, Streptococcus thermophilus
MEENIVSENNMKHRSSVYDSMVKSPNRAMLRATGMTDDSFEKPIVGVISTWAENTPCNIHLHGFGQIAKEGVKDAGAWPVQFGTITVADGIAMGTPGMRFSLTSRDIIADSIEAAMGGHNVDAFVAIGGCDKNMPGSMIAIANMDIPAIFAYGGTIAPGNLNGKDIDLVSVFEGIGKWNHGDMTAEEVKNLECNACPGPGGCGGMYTANTMATAIEVMGMSLPGSSSHPAESAEKKADIEEAGRAVVKMLEMGLKPSDILTREAFEDAITVTMALGGSTNATLHLLAIAHAANVDLTLEDFNDFQERVPHLADLKPSGQYVFQDLYNVGGVPAVMKYLLKNGFLHGDRITCTGKTVAENLEAFDDLTPGQKVIMPLENPKRADGPLIILKGNLAPEGAVAKVSGVKVRNITGPAKVFDSEEDAIEAVLSDEIVDGDVVVVRFVGPKGGPGMPEMLSLSSMIVGKGQGDKVALLTDGRFSGGTYGLVVGHIAPEAQVGGPIAYLRTGDMVTVDQDTKEITMHVPDEELAKRKAETELPPLYSRGVLGKYAHIVSSASRGAVTDFWNMDKSGKA

SEQ ID NO: 165 - DNA, 1716 bp, Streptococcus suis
atgaccgatacaaacaaacttaaagactttcgacatcgcagctctgtttacgattcgatggtcaaatcgcccaaccgtgctatgttaagagcaacaggaatgaccgacgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggtatgcgcttctccttgacttcacgtgatatcattgcagattctattgaggcagctatgggagggcacaacgtggatgcctttgtcgcaatcggtggctgtgataaaaacatgcctggttctatgattgctatcgccaatatggatatccctgctgtttttgcctacggcggaaccattgcgccaggtaatctcaatggtaaagacatcgacttggtatccgtttttgaaggaatcggaaaatggaacaacggtgacttgaccgctgaagaggttcgtcaaatcgagtgtaacgcttgccctggacctggtggttgcggtggtatgtacactgccaataccatggcgacagccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataa

SEQ ID NO: 166 - protein, 571 aa, Streptococcus suis
MTDTNKLKDFRHRSSVYDSMVKSPNRAMLRATGMTDDSFEKPIVGVISTWAENTPCNIHLHDFGKLAKEGVKEAGAWPVQYGTITVADGIAMGTPGMRFSLTSRDIIADSIEAAMGGHNVDAFVAIGGCDKNMPGSMIAIANMDIPAVFAYGGTIAPGNLNGKDIDLVSVFEGIGKWNNGDLTAEEVRQIECNACPGPGGCGGMYTANTMATAIEVMGMSIPGSSSHPAESPEKKADIEEAGRAVVRMLELGIKPSDIMTREAFEDAITVTMALGGSTNATLHLLAIAHAANVDLTLEDFNDFQERVPHLADLKPSGKYVFQDLYNVGGVPAVMKYLLKNGFLHGDRITCTGKTVAENLKNFADLTPGQDVIMPLENPKRADGPLIILKGNLAPEGAVAKVSGVKVRNHTGPAKVFDSEEEAIEAVLTDEIVDGDVVVVRYVGPKGGPGMPEMLSLSSMIVGKGQGDKVALLTDGRFSGGTYGLVVGHIAPEAQDGGPIAYLRTGDLVTVDQDTKEITMHVSDQEIEERKKTTVIPPLYSRGVLGKYAHTVSSASKGAVTDFWRPERTGKK

SEQ ID NO: 167 - DNA, 1716 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 168 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 169 - DNA, 1683 bp, Leptospira borgpetersenii
atgagcgatatattaaaaaaaagaagttcgatgactacggacggagataaccgcgcgcccaatcgagcgatgcttcgcgcggtcggctttacggacgaagatttccacaaacctatgatcggaatcgcttccacatggagcgaagtgacgccttgtaatattcatatcaataagttggccgaaaaagtcaaagagggcgttcgtacggcgggaggagttcctcaaatttacggaaccatcacggtttccgacggaattacgatgggtcacgaagggatgcatttttcacttccctccagagaagtgattgcggattcaatcgaaatcgtttccaacgcgatgagacacgacggagtgatcgcgatcggaggttgtgataagaacatgcccggatgtctcatggctctttgcagaatcgatgctccttctattttcgtttacggggggaccattcttccggggcattgcgacggtcaagacgtggatatcgtttccatcttcgaagctgttggtaaatttaatgcaggtaaaatttcaagagaagaattcattcgaatcgagcagaacgcgtgtcccggcgcaggaagttgcggggggatgtataccgcaaatacgatgtcctccgcgatagaagctcttgggatgagtctgccaggttcggcttccatgcccgcggtgagttctagaaaatcggaggattgttacgaggcgggaaaagctctcatcaatctcattcaaaagggagtcactccgaagcgaattcttaccaaaaaagcttttgagaacgcgatcaccgtagtgcttgtgttaggcggttcaaccaatgcggtccttcatttgattgcgatcgcgaaagagattggtgtggatcttactctcgaagactttgatcgaatcagtaaaaaaactcctcaccttgcggatttgaaaccgggtggtagatacgccatgaccgatctcgacaaagtgggcggggttcatggtgtgatgaagtatcttttgaaagaaggaatgcttcatggtgattgtcttacggttacgggaaaaacaattgcagaaaatctaatggatatgcccgatctcgttccaaaccagacgatcgtccgtaaaaaatcggaggcgctccatccttccggtcctcttgtgattttgaaaggaaaccttgccccggaaggtgcggttgctaaaatttccggtttgaagaaaatttccatcacgggcccggcgaaagtgttcgaatccgaagacgattgtttcaatgcgatcatgacggatcaaattaaaccgggcgacgtgattatcattcgttacgaaggtcccaaaggtggtcccgggatgagagagatgctcgcggtaacttcggcgcttgtcggaaaaggtttgggagaagacgtgggtctgatgacagacggtcgattcagtggaggaacgcacggtctcgtagtcggtcatatttctcccgaagcatttgatggaggtccgattgcgatcgttcaaaatggggatgcggttactatcgattccggtaaaaatttgctccaagttgaaatttctcaggaagaaattcagaaacggctaaaaaattggaaaccgattgaaccgagatataaatccggggttcttgcgaaatacgcaaaactggttcaatcggcgactaacggagcgattacgaatctgctttga

SEQ ID NO: 170 - protein, 560 aa, Leptospira borgpetersenii
MSDILKKRSSMTTDGDNRAPNRAMLRAVGFTDEDFHKPMIGIASTWSEVTPCNIHINKLAEKVKEGVRTAGGVPQIYGTITVSDGITMGHEGMHFSLPSREVIADSIEIVSNAMRHDGVIAIGGCDKNMPGCLMALCRIDAPSIFVYGGTILPGHCDGQDVDIVSIFEAVGKFNAGKISREEFIRIEQNACPGAGSCGGMYTANTMSSAIEALGMSLPGSASMPAVSSRKSEDCYEAGKALINLIQKGVTPKRILTKKAFENAITVVLVLGGSTNAVLHLIAIAKEIGVDLTLEDFDRISKKTPHLADLKPGGRYAMTDLDKVGGVHGVMKYLLKEGMLHGDCLTVTGKTIAENLMDMPDLVPNQTIVRKKSEALHPSGPLVILKGNLAPEGAVAKISGLKKISITGPAKVFESEDDCFNAIMTDQIKPGDVIIIRYEGPKGGPGMREMLAVTSALVGKGLGEDVGLMTDGRFSGGTHGLVVGHISPEAFDGGPIAIVQNGDAVTIDSGKNLLQVEISQEEIQKRLKNWKPIEPRYKSGVLAKYAKLVQSATNGAITNLL

SEQ ID NO: 171 - DNA, 1665 bp, Candidatus Vesicomyosocius okutanii
atgtgcatcccaagaaaatattcctcacaagttgttgatggatttgaacgcgcaccaagtcgtgctatgctttaccccattggttttaaaaaagatgattttagcaaaccccaggttggtatagcaagcacttggtcaatggtaacaccatgtaatatgcatattaataaattagctgataaagccgaaaaagggataaataacgcaggtggtaaaggtgttatctttaacaccattaccatatcagatggtatttctatgggctctgaaggtatgaaatattccttagtatcacgcgaagtcattgccgattcaattgaaacagttgttggttgtcaagggtttgatggtgtggttgctattggtgggtgtgataaaaatatgcctggttgtattattggcttagcacgtcttaatcgccctagtatttttgtttatggcggtactattcaaccgggtaaaaatcgtacagatgtggtaagtgttttcgaagcagttggccgattttctaaccatgaaattgatgaaatagaactagaaaatattgaaaaaacagccgttactggagcaggttcttgtggtggtatgtacactgctaatactatggcatcagcaattgaagcattaggtatgagtttacccaactccagcgcacaaaatgctatatcagatgataaaaataatgattgtatccaagctggagaagctattcttactttattaaataaagacattaaaccccgtgatataatgactatgaaagcattcgaaaatgccatcactgtaattattgcattgggtggctcaaccaatgctgtattgcatttaattgccatggcaaatgccgctgaggttaatctcaaaattgatgattttactcgcattggtaaaaaagtacctgttattgctgaccttaaaccatcaggtaaatatatgatgagtgaattggttgaaattgggggtacattaccactaatgaaaatgctacttgatgcaggactattacatggggattgcatgacagtaacaggaaaaactttagctaaaaatttaaaaaatgttcaatcatatgctgattcccaagaaattattagagcattagataacccaataaagaaagattcacaccttagaattttgcgtggtaaccttgcaattaatggtgctgtggcaaagattactggtaaagaaggttcaagtttcaaaggtacagctaaatgtttttctcatgaagaaggagcgcttaaggctattttaaatgaccaaataaaagcaggtaatgttatcgttattcgttacgaggggcctgttggtggtcctggtatgcgtgaaatgcttgctcctacttctgcagttatggggaaaggattgggtggtaaaattgcacttattactgatgggcgcttctctggtggtacacatggttttgtagtcgggcatatcactcctgaagcctttaaaggtggagtgctagcagtggttgaagatggtgatgaaattataattgatgcacaaaataacgttttagaactattagttgatcaagctattattgataaacgcttatctaaatggacgcaacctaaaccaaactacactaaaggtgtattagcaaaatttgcaaaactagctaaatctgcttctgaaggtgcagttactgattaa

SEQ ID NO: 172 - protein, 554 aa, Candidatus Vesicomyosocius okutanii
MCIPRKYSSQVVDGFERAPSRAMLYPIGFKKDDFSKPQVGIASTWSMVTPCNMHINKLADKAEKGINNAGGKGVIFNTITISDGISMGSEGMKYSLVSREVIADSIETVVGCQGFDGVVAIGGCDKNMPGCIIGLARLNRPSIFVYGGTIQPGKNRTDVVSVFEAVGRFSNHEIDEIELENIEKTAVTGAGSCGGMYTANTMASAIEALGMSLPNSSAQNAISDDKNNDCIQAGEAILTLLNKDIKPRDIMTMKAFENAITVIIALGGSTNAVLHLIAMANAAEVNLKIDDFTRIGKKVPVIADLKPSGKYMMSELVEIGGTLPLMKMLLDAGLLHGDCMTVTGKTLAKNLKNVQSYADSQEIIRALDNPIKKDSHLRILRGNLAINGAVAKITGKEGSSFKGTAKCFSHEEGALKAILNDQIKAGNVIVIRYEGPVGGPGMREMLAPTSAVMGKGLGGKIALITDGRFSGGTHGFVVGHITPEAFKGGVLAVVEDGDEIIIDAQNNVLELLVDQAIIDKRLSKWTQPKPNYTKGVLAKFAKLAKSASEGAVTD

SEQ ID NO: 173 - DNA, 1680 bp, Candidatus Ruthia magnifica
atgcgaagaaaaattatgtacaacccaagaaaatactcctcacaagttgttgacggatttgaacgcgcgccaagtcgtgccatgctttatccagttggatttacaaaagaggattttaacaagcctcaagtcggcatagcaagcacttggtcaatggtaacaccgtgtaatatgcacattaataaattggctgatgagacattaaaaggggtaaatgccacaggtggtaaagccattatttttaacactattactatttcagatggtatttctatgggctctgaaggcatgaagtactctttagtctcacgtgaagttattgccgattcaattgaaactgtggttggttgtcaaggttttgatggtgtggttgcaattggtggttgcgataaaaacatgcctggttgtattattggtttggtacgtcttaatcgccctagtatttttgtttatggaggcacaatccagccgggtaaaaatcatacagatgtggtgagtgtttttgaagcagttggccaatttgccaatcatacaattgatgcgattgaattagaaaatattgaaaaaatagctatccctggtccaggctcttgtggcggtatgtatacggctaacactatggcatcagcgattgaagcattaggtatgagcctgccaaattctagtgcgcaagatgctatttcagatgataaaaataacgactgtgttcaagctggacaggccgtccttaatttattaaacaaagacattaaacctcgtgacattatgaccatgaaggcatttgaaaatgctattaccgtaattattgcattgggtggctcaactaatgctgtattgcatttaattgccatggcaagtgctgctgaggttaatcttaaaattgatgactttactcgcattggccaaaaagtacccgttattgctgaccttaaaccatcaggcaaatacatgatgagtgaattggttaaaattggcggtacattgccgctaatgaaaatgttacttgatgcaggattattgcacggagactgcctaacagtaacaggaaaaactctagctgaaaatttagaaaatgttaagccatacgctgattctcaagaaatcattagagcactagacaacccaataaaaaaagattcacaccttagaattttacgtggcaatcttgcaaccgatggtgctgttgcaaaaattactggcaaagaaggtttgagtttcaaaggcaatgcgaaatgtttttctcgtgaagaggatgcgcttgaagccattttaaataatcaaataataacaggtgatgtgattgttattcgctatgaaggccctgtcggaggtcctggtatgcgcgaaatgctcgcccctacttctgcagttatgggcaaaggcttaggtgataaagttgcgttaattaccgatggtcgtttttctggcggtacacatggttttgtagtcggtcacatcacccctgaagcctttgaaggtggtgtactggctgtggttaaagatggagatgaaatcttaattgatgcacaaaacaacgttttagagttattagttgagcaagcaattatcgataaacgtctatataattggacacaacccaaaccaaactacaccaaaggtgtattggctaaatttgcaaagttggctaaatctgcctctgaaggtgcagtgactgattag

SEQ ID NO: 174 - protein, 559 aa, Candidatus Ruthia magnifica
MRRKIMYNPRKYSSQVVDGFERAPSRAMLYPVGFTKEDFNKPQVGIASTWSMVTPCNMHINKLADETLKGVNATGGKAIIFNTITISDGISMGSEGMKYSLVSREVIADSIETVVGCQGFDGVVAIGGCDKNMPGCIIGLVRLNRPSIFVYGGTIQPGKNHTDVVSVFEAVGQFANHTIDAIELENIEKIAIPGPGSCGGMYTANTMASAIEALGMSLPNSSAQDAISDDKNNDCVQAGQAVLNLLNKDIKPRDIMTMKAFENAITVIIALGGSTNAVLHLIAMASAAEVNLKIDDFTRIGQKVPVIADLKPSGKYMMSELVKIGGTLPLMKMLLDAGLLHGDCLTVTGKTLAENLENVKPYADSQEIIRALDNPIKKDSHLRILRGNLATDGAVAKITGKEGLSFKGNAKCFSREEDALEAILNNQIITGDVIVIRYEGPVGGPGMREMLAPTSAVMGKGLGDKVALITDGRFSGGTHGFVVGHITPEAFEGGVLAVVKDGDEILIDAQNNVLELLVEQAIIDKRLYNWTQPKPNYTKGVLAKFAKLAKSASEGAVTD

SEQ ID NO: 175 - DNA, 1689 bp, Methylococcus capsulatus
atgaccgacaagcacccccgtccccattcgtcccaggtcgtcgacggcatggagcgcgccccgagccgcgcgatgctgcacgccgtcggcttcgccgatgccgacttcgccaaaccgcagatcggcatcgcttccacctgggcgatggtgacgccgtgcaacatgcacatcaacaagctcgccgaggacgcagcacgcggcgtcgacggcggcggcggcaaggcagtgatcttcaacaccatcaccatttccgacggcatctcgatgggcaccgaaggaatgaaatactccctcgtgtcgcgggaagtcatcgccgactcgatcgaaaccgtggtggcctgtcagggttatgacggcgtggtcgccatcggcggctgcgacaagaacatgcccggctgcctgatcgccctcgcccgcctcaaccgtccggcggtgttcgtctatggcggcaccatcctgccgggctgccacgacggcaagaagctggacgtggtgtcggtgttcgaagcggtcggcgcccgcgccaaccaccgcatcgacgatgccgaactgcacgccatcgaatccaatgccatccccggtccgggctcctgcggtggcatgtataccgccaacaccatggcctccgccatcgaggcattagggatgagcctgccgggcagttcggcccaggtggccatttcccgcgccaaggaactggattgcgagcgggccggcgcgcaggtcctcaagctcctggacctggggctcaaaccccgcgacatcatgaccaagaaggcgttcgagaacgccatcacggtggtgatcgccctgggcggctccaccaacgccgtgctgcacctcctggccatggccaacgcctgcggcgtcgacctgaagctcgacgatttcacccgcatcgggcgcaaagtgccgatgctggcggatctgaaacccagcggcagatactccatggccgaactggtggaaatcggcggcatccagccgctgatgaagaccttgctggacgcgggactcctgcacggcgactgcatgaccgtaaccggcaagaccctggaagaaaacctggccgacgcgcccgactacccggccggacaagacatgatccggtcgctggacaaccccatcaaaaaggacagccatctggtgatcctcaagggcaacctggcgccggaaggcgcggtcgccaagatcaccggcaaggaaggactgagcttcaccggcaccgcccgcgtattcgactgcgaggaagcggcgctcacggccatcctcgacggcacgatcgtgaaaggcgacgtcatcgtcatccgctatgaaggccccaagggcggccccggcatgcgcgagatgctctcgccgacctcggcggtcatgggcaagggattgggcaaggaggtcgccctcatcaccgacggccgcttttccggcggcacccacggcttcgtggtcggccacatcacgccggaagcctacaccggcggccccctggcgatcgtccgggacggcgataccatcaccatcgacgccgagacccgcgaattgagcctgcacgtcaccgacgatgaaatcggccggcgcctggcgcagtggactcaaccggcgccgcgctacaccaagggcgtgctggccaaatacgccaggttggtgagcccggcctcggaaggcgccgtcaccgacgacggcctctga

SEQ ID NO: 176 - protein, 562 aa, Methylococcus capsulatus
MTDKHPRPHSSQVVDGMERAPSRAMLHAVGFADADFAKPQIGIASTWAMVTPCNMHINKLAEDAARGVDGGGGKAVIFNTITISDGISMGTEGMKYSLVSREVIADSIETVVACQGYDGVVAIGGCDKNMPGCLIALARLNRPAVFVYGGTILPGCHDGKKLDVVSVFEAVGARANHRIDDAELHAIESNAIPGPGSCGGMYTANTMASAIEALGMSLPGSSAQVAISRAKELDCERAGAQVLKLLDLGLKPRDIMTKKAFENAITVVIALGGSTNAVLHLLAMANACGVDLKLDDFTRIGRKVPMLADLKPSGRYSMAELVEIGGIQPLMKTLLDAGLLHGDCMTVTGKTLEENLADAPDYPAGQDMIRSLDNPIKKDSHLVILKGNLAPEGAVAKITGKEGLSFTGTARVFDCEEAALTAILDGTIVKGDVIVIRYEGPKGGPGMREMLSPTSAVMGKGLGKEVALITDGRFSGGTHGFVVGHITPEAYTGGPLAIVRDGDTITIDAETRELSLHVTDDEIGRRLAQWTQPAPRYTKGVLAKYARLVSPASEGAVTDDGL

SEQ ID NO: 177 - DNA, 1662 bp, unknown
  uncultured marine bacterium EB80_02D08
atgacaaatagaaaatattcaaaagaacttttagatggaccaaatcaagcagcatcaagatcaatgcttagaggagtaggatttacatctgatgatttcaagaagccacttgtaggaattgcatcaactggggcaaaagttactccatgcaatatgcatattaatcagctgtcagaaattgttgagcattcagttgataattccggaggtaaaggagtgctattcaatactattacagtttctgatggtatatcaatgggaacacaaggcatgaaatactcactcgtttcaagagaagtcatagcagattctatagaaactgttgtgggctgtcttggttatgatggtgttatagcagttggtggatgtgataaaaatatgcccggatgtattatcggcatggcaaggcttaatagaccttccatatttatatatggtggctcaatcagacccagtgaagaaaataccgattatgtaactgtatgtgaaaagactggtgagttttctaaaggcgatctagacgaatctcaactaattcatgtagaaaaaatatctgtaaagggtcctggatcctgtggaggtatgtatacagccaatactatggcatctgctattgaggcattgggtatgagtcttcctggaagtagcagtcaagatgctgtctcaaatgataaagaagatgattgcataaaagctggtatagcgatcatgggcttattagaaaaagacatcaagccttcagacattatgacaaaaaaagcttttgagaattctataactatggtgattgctttaggcggttccacaaatgcagtacttcatttacttgctatggctgatgcaattggagttgatttaacgcttgatgactttacaagaatcggtaaaaagacgccagtcttagcagatttaaagccttttggctctcattatatgtctgagcttaatgcaaatggagggatacagccgctaatgaaaacccttttagataaaggcttacttcatggtgattgtcttactgttacagggaaaacactctcagaaaatctttctttagttaaaccttatgaattacatcaagatattatcaaggagtttgatagtccaataaaagctaatagtcatctcaggatactatatggaaatttagctgaagaaggagcggttgcaaaaataacaggaaaagagggaacttcttttgaaggtagcgctcgagtttttaattcagaggaagaaggcgttgaggctattttatcaaaatcaattaaacctggcgacgttgtagtaataagatatgagggaccaaaaggtggtcctgggatgagagaaatgttgaagcctacttcggcaatcatgggccaaggcctgggagataaagttgcatttattaccgatggtcgtttttcaggaggtactcatggttttgttgttggacacattacaccagaagcggcagatggtgggctaatagcaattattgaagatggtgattcaatactaattgatgcaaactcggataaactagtactgaatatctctgatgatgagatttcaactagacttagtaaatgggttaaccctaaaacgcctccaagaaaaggtgttctagcaaaatttgcacgaaatgttaaatcagcaagtcttggagcggtgacagattaa

SEQ ID NO: 178 - protein, 553 aa, unknown
  uncultured marine bacterium EB80_02D08
MTNRKYSKELLDGPNQAASRSMLRGVGFTSDDFKKPLVGIASTGAKVTPCNMHINQLSEIVEHSVDNSGGKGVLFNTITVSDGISMGTQGMKYSLVSREVIADSIETVVGCLGYDGVIAVGGCDKNMPGCIIGMARLNRPSIFIYGGSIRPSEENTDYVTVCEKTGEFSKGDLDESQLIHVEKISVKGPGSCGGMYTANTMASAIEALGMSLPGSSSQDAVSNDKEDDCIKAGIAIMGLLEKDIKPSDIMTKKAFENSITMVIALGGSTNAVLHLLAMADAIGVDLTLDDFTRIGKKTPVLADLKPFGSHYMSELNANGGIQPLMKTLLDKGLLHGDCLTVTGKTLSENLSLVKPYELHQDIIKEFDSPIKANSHLRILYGNLAEEGAVAKITGKEGTSFEGSARVFNSEEEGVEAILSKSIKPGDVVVIRYEGPKGGPGMREMLKPTSAIMGQGLGDKVAFITDGRFSGGTHGFVVGHITPEAADGGLIAIIEDGDSILIDANSDKLVLNISDDEISTRLSKWVNPKTPPRKGVLAKFARNVKSASLGAVTD

SEQ ID NO: 179 - DNA, 1599 bp, unknown
  uncultured marine gamma proteobacterium EBAC31A08
atgcttagaggagtaggtttcacatctgaggmtttcacaaaaccatttgttgggattgcttccacaggagcaaaagtaaccccatgcaatatgcacataaatgcactttcagagatcgttgagaaatcagttgatagttcaggaggaaagggtgttctttttaatactattactgtttccgatggaatttctatgggtacacagggtatgaaatattctcttgtttctcgagaggtaattgcagattcaatagaaactgttgtgggatgtcttggttatgatggagttattgctgtcggtggttgtgataaaaatatgcctggatgcattattggaatggcaagattaaatagaccatcaatatttatatatggtggttctatcaaacctagtaaagaaaataccgactatgttactgtttgtgagaaaactggagagtactcaaaaggcgatcttaaagaatctgaattaattcatgtagaaaaaatttccgtaaaagggcctggatcttgtgggggaatgtatacggcaaatactatggcttctgcgattgaagctctaggcatgagtcttcctggaagcagcagtcaagatgcaatttcacacgacaaagaagatgattgttttaaggctggcgaagcgataatgaatttattagaaaaagatattaagccttcagatattatgactaagaatgcttttgagaatgctataacaatggtaattgctctaggaggttcaactaatgcagttctgcatttattggccatggcgcattcaataggggttgatttagagctagatgactttacaagaataggaaaaaaaacacccgttatggcagatcttaagccctttggttctcattatatgtctgaactcaatgctaatggcggtattcagccactaatgaaaactttgcttgagaagggattactacacggcaattgtcttaccgttaccggtcagacgcttgctgaaaatctttctggaataaaaccttacgagcctgatcaagagataattaaatcatttgataatccaattaaatcaaatagccatcttagaattctgtatggcaacttagcgaaagatggtgcagttgcaaaaattacgggtaaagaaggaacttcctttgaaggaagtgctcgtgtatttgattcagaagaagaaggggttaaagcaatcctatctaaatctataaaagctggagatgttgttgtaattagatatgaagggccaaaaggaggtccaggcatgagagaaatgctaaaaccaacatctgccataatgggtcaaggtcttggcgatcaggtagcttttataacagacggtcgtttttcaggaggcactcatggatttgttgttgggcacattactccagaggctgcagatggcggcttaattgcaataattaaagatggcgactctatattaattgatgcagattctgataagttaattcttaatatttctgaggatgaaatttcaaatagactaagtagatgggtaaacccaaaaacgcctcccaaaaaaggagtcttagcaaaatttgcaaaaagtgttaaatcagctagtcttggagcggtaacagattaa

SEQ ID NO: 180 - protein, 532 aa, unknown
  uncultured marine gamma proteobacterium EBAC31A08
  misc_feature (11)..(11): Xaa can be any naturally occurring amino acid
MLRGVGFTSEXFTKPFVGIASTGAKVTPCNMHINALSEIVEKSVDSSGGKGVLFNTITVSDGISMGTQGMKYSLVSREVIADSIETVVGCLGYDGVIAVGGCDKNMPGCIIGMARLNRPSIFIYGGSIKPSKENTDYVTVCEKTGEYSKGDLKESELIHVEKISVKGPGSCGGMYTANTMASAIEALGMSLPGSSSQDAISHDKEDDCFKAGEAIMNLLEKDIKPSDIMTKNAFENAITMVIALGGSTNAVLHLLAMAHSIGVDLELDDFTRIGKKTPVMADLKPFGSHYMSELNANGGIQPLMKTLLEKGLLHGNCLTVTGQTLAENLSGIKPYEPDQEIIKSFDNPIKSNSHLRILYGNLAKDGAVAKITGKEGTSFEGSARVFDSEEEGVKAILSKSIKAGDVVVIRYEGPKGGPGMREMLKPTSAIMGQGLGDQVAFITDGRFSGGTHGFVVGHITPEAADGGLIAIIKDGDSILIDADSDKLILNISEDEISNRLSRWVNPKTPPKKGVLAKFAKSVKSASLGAVTD

SEQ ID NO: 181 - DNA, 1659 bp, unknown
  uncultured marine gamma proteobacterium EBAC20E09
atgagctctagaaaatattcaaaagaccttgttgatggcccaaatcaagctgcatcaagatcaatgctgcgtggggttggatttactactgaagatttttcaaaatcttttgtaggcattgcatcaacaggtgcaaaagttacaccgtgtaatatgcatatcaataaacttgcagaagttgttgagaattcggtgaatgtatctggaggtaaaggagtactttttaatactattactgtatcagacggcatatcaatgggaactcaaggcatgaaatattctcttgtatcaagagaggttatagctgattcaattgaaacagttgttggttgtttaggttatgatggcttaatcacaattggtggctgtgataagaacatgcctggctgtttgataggcatggcaagattgaaccgaccatccattttcatttatggggggtcaattaagccaagtaatgaaaaaaccgactatgtcacagtatcagaaaaggttggtgaattctccaaaggcgacattgatgaaaaagaactcattcattatgaaaaaatttcagtagaaggcccaggatcatgcggtggtatgtataccgcaaatacaatggcttcagctatcgaagctttaggaatgagtttaccaggcagcagcagtcaagatgcagtttcaaaatctaaaaatgaagattgcatttctgcaggaatagccataatgaatttgcttgaaaaagatttaaaaccctctgacattatgacaaaggaggcttttgaaaatgcaattacagttgttattgcattaggtggatcgacaaatgctgttcttcatttattagctatggctcatgccgtaggtgtcgaacttcaattggatgattttacaaaaattggaaaactcactccggtacttgcagacctcaaaccatttggtaatcattttatgtctgagttaaatgcaaacggtggaatacagccactaatgaaaagtttattagataaaggaatgctgcatggaaattgtttgacggttactggtaattcattagaagaaaatttaaaagatatagagccgtataaagatgaaaaaataataaaaagcttagataatccaattaaatctgatagtcatttaagagtgttatatgggaacttagctaaggatggcgctgttgcaaaaattacaggaaaggagggcttttcatttgaaggcaaagccaaagtatttaactcggaagaagatggagttcaggcaatccttgcaaaaaaaattgttccaggtgatgtagttgtaattagatatgagggaccaaaaggtggtccgggcatgagagaaatgttaaagccaacatctgcgatcatggggttaggcttaggagataaagttgcttttataactgacggtagattttctggaggaactcatggatttgttgtgggccatgtatctccagaggcagcagatggaggcctaattgctttaatcaaagatggagacaatatcttgatagatgcagaaaatgatgaattaatactaaaggttgatcaagacgaaattgatttaagaaagaagaactggaaaaatcctactaatcctcctaaaaaaggagttcttgcaaagtatgctgcaagtgtaaaatctgccagcttaggagcaattactgattaa

SEQ ID NO: 182 - protein, 552 aa, unknown
  uncultured marine gamma proteobacterium EBAC20E09
MSSRKYSKDLVDGPNQAASRSMLRGVGFTTEDFSKSFVGIASTGAKVTPCNMHINKLAEVVENSVNVSGGKGVLFNTITVSDGISMGTQGMKYSLVSREVIADSIETVVGCLGYDGLITIGGCDKNMPGCLIGMARLNRPSIFIYGGSIKPSNEKTDYVTVSEKVGEFSKGDIDEKELIHYEKISVEGPGSCGGMYTANTMASAIEALGMSLPGSSSQDAVSKSKNEDCISAGIAIMNLLEKDLKPSDIMTKEAFENAITVVIALGGSTNAVLHLLAMAHAVGVELQLDDFTKIGKLTPVLADLKPFGNHFMSELNANGGIQPLMKSLLDKGMLHGNCLTVTGNSLEENLKDIEPYKDEKIIKSLDNPIKSDSHLRVLYGNLAKDGAVAKITGKEGFSFEGKAKVFNSEEDGVQAILAKKIVPGDVVVIRYEGPKGGPGMREMLKPTSAIMGLGLGDKVAFITDGRFSGGTHGFVVGHVSPEAADGGLIALIKDGDNILIDAENDELILKVDQDEIDLRKKNWKNPTNPPKKGVLAKYAASVKSASLGAITD

SEQ ID NO: 183 - DNA, 1659 bp, unknown
  uncultured gamma proteobacterium eBACHOT4E07
atgagctctagaaaatattcaaaggaattagttgatggtccaaatcaggccgcatctcgttctatgcttcgaggtgtaggatttacatctgaggactttacaaagccatttgttggaattgcatcaactggagccaaagttacaccatgtaatatgcatatcaatcaattatcagaattggtagaagactcaataaatgcatctggtggcaaaggtgttttatttaatacaattactgtttctgatggcatttcaatgggaacgcaaggaatgaaatattctcttgtttcaagagaagttattgctgactcaattgaaactgttgtaggttgccttggatatgatggattaattgcaattggtggatgtgataagaacatgcctggatgtcttattggtatggcaagattaaatagaccgtcaatatttatttatggtggatctataaaaccaagtaatgagaatacggactatgtcactgtctcagaaaaagttggagaattctcaaagggctctataaatgaagatgagctaattcattatgaaaagatatcagttgatggaccaggctcatgtggcggaatgtatacagcaaatacaatggcatctgccatagaggcattaggaatgagtttgccaggtagcagtagccaagatgcaacatctaaatcaaagaacgctgattgtgtgaatgctggatcggcaatcatgaatttactagataaagatattaaaccttctgacattatgacaagagaagcatttgaaaatgctataactgttgtaatagctctaggaggatcaacaaatgccgttcttcatttattggccatggctcattcaattggagttgaactttgcttagatgactttacttcaattggaaagaaaacacctgtattagcggacctaaaaccctttggaaaacactatatgtctgagcttaatgcaaatggaggaattcagcccttaatgaaaactcttttagacaaaggacttcttcatggtcaatgtatgacagttacaggcaataccttagaagaaaatttaaaagacataaaagcatatgagacgagtgaaataattaaagattttaataatccaatcaaaaaagatagtcatcttagaattttatacggcaaccttgctaaagatggcgcggttgcaaaaattacaggtaaagaaggaacatcttttgaaggaaaagcaaaagtatttaattcagaagaagagggcgtaagtgcgattctatcaaatcagattaatgatggtgatgtaatcgtaataaggtatgagggtccaaagggtgggcctggcatgagagaaatgctaaaacctacttctgcaatcatgggattaggactaggagataaaataggatttattacagatggaagattttcaggtggcacccatggttttgtagttggacatgtttctccagaagcagctgagggtggtttaatagcattagttgaagatggagatactatacttattgatgcagaaagtgatcagcttgttctaaaagttgatgatgatgaaattaaaagaagacaatcaatttggaaaaatccaaacagtaaaccaaaaaaaggagtacttgctaagtatgctgagagcgtaaaatctgcaagcctgggagctataactgattaa

SEQ ID NO: 184 - protein, 552 aa, unknown
  uncultured gamma proteobacterium eBACHOT4E07
MSSRKYSKELVDGPNQAASRSMLRGVGFTSEDFTKPFVGIASTGAKVTPCNMHINQLSELVEDSINASGGKGVLFNTITVSDGISMGTQGMKYSLVSREVIADSIETVVGCLGYDGLIAIGGCDKNMPGCLIGMARLNRPSIFIYGGSIKPSNENTDYVTVSEKVGEFSKGSINEDELIHYEKISVDGPGSCGGMYTANTMASAIEALGMSLPGSSSQDATSKSKNADCVNAGSAIMNLLDKDIKPSDIMTREAFENAITVVIALGGSTNAVLHLLAMAHSIGVELCLDDFTSIGKKTPVLADLKPFGKHYMSELNANGGIQPLMKTLLDKGLLHGQCMTVTGNTLEENLKDIKAYETSEIIKDFNNPIKKDSHLRILYGNLAKDGAVAKITGKEGTSFEGKAKVFNSEEEGVSAILSNQINDGDVIVIRYEGPKGGPGMREMLKPTSAIMGLGLGDKIGFITDGRFSGGTHGFVVGHVSPEAAEGGLIALVEDGDTILIDAESDQLVLKVDDDEIKRRQSIWKNPNSKPKKGVLAKYAESVKSASLGAITD

SEQ ID NO: 185 - DNA, 1686 bp, Alcanivorax borkumensis
atgagtgactcaaagggcgatccgcgtcgccgccattcagcaaaggtcgtggacggccccggtaaatccgccagccgggccatgctgcgggcggtggggtttaccgatgaggattttcataaaccccaggtgggcattgcttctacttggagtcaggtgacgccgtgcaatagccatatcggtgagctcgccgaaaaagcctgcgctggagccgatgcggccggcggcaaaggggtaattttcaataccatcaccatctccgatggcatcgccaatggtaccgaagggatgaagtattcgttggtctcccgcgaggtgattgccgattccattgaaaccgtggcggcttgtgaaggctttgacggcctggtagctcttggtggctgcgataagaacatgcccggttgcctaatgggcatggcgcggctgaatcgccccagcgtctttgtctacggcggcaccatcatgcccggcaagggccacacggatattgtttctgtgttcgaagccatgggagcccattcccgcggcgacatggacaaaatcgaactcaagcagatagaagaaactgccattcccgggcccggtgcttgcggcggcatgtacacggccaacactatggcctcggctattgaagcgctgggcatgagcctgccgggcagctccgcacagaatgcggtgtcggaagagaagcgtgatgattgccagcgcgccggcgaagcagtgttggcgctactggaacaggacatcaagccctcggacatcatgacgcgggctgcatttgagaacgccatcactgtggtgatcgccctgggcggttccaccaatgcggtgctgcacctgatcgccatggcgcgcaccgtgggggtgccgctgtcgctggatgactttaccgagatcggcaggcgggtgccggtgctggcggacctgcgccccagtggccattacatgatgagcgagttggtggccatcggcggtattcagccgttgatgaaggtgctgttggaggcgggtttgctgcagggtgattgcctgacggtcaccggccgtaccttggctgagaacctggcggatgtcagtccttatccactggatcagacgatcatcgcgccactgtctgcgccgctgaaagcagaaagtcacctgcgcatcctttatggcaatttggcgccggatggcgcagtggccaagatcaccggcaaggaaggcacccacttttccggcccggcccgggtgttcggttcggaagaagaagcgcagcagcggatcaatgatgggactgtggtgtccggggacgtggtggtgatccgctatgaaggcccccgcggcggcccaggcatgcgtgaaatgctcacccccacctctgccatcatggggcgcggcctgggtgacgaggtggcgctgattaccgatggtcgcttttccggcggcagccatggtttcgtggtaggccacgtgaccccagaagctttcgatggtggtccgctggcattattggaaaacggtgaccaaattaccattgatgccgaagccaacaccctggtcgtggcgctgtctgatgcggagttggcgcgccgccgtgctaactggcaacagccagcaccacgctatacccgtggtgtgctggccaaatacgcacggctggtgggttcggccagcgaaggcgcgctgacggacttaggttaa

SEQ ID NO: 186 - protein, 561 aa, Alcanivorax borkumensis
MSDSKGDPRRRHSAKVVDGPGKSASRAMLRAVGFTDEDFHKPQVGIASTWSQVTPCNSHIGELAEKACAGADAAGGKGVIFNTITISDGIANGTEGMKYSLVSREVIADSIETVAACEGFDGLVALGGCDKNMPGCLMGMARLNRPSVFVYGGTIMPGKGHTDIVSVFEAMGAHSRGDMDKIELKQIEETAIPGPGACGGMYTANTMASAIEALGMSLPGSSAQNAVSEEKRDDCQRAGEAVLALLEQDIKPSDIMTRAAFENAITVVIALGGSTNAVLHLIAMARTVGVPLSLDDFTEIGRRVPVLADLRPSGHYMMSELVAIGGIQPLMKVLLEAGLLQGDCLTVTGRTLAENLADVSPYPLDQTIIAPLSAPLKAESHLRILYGNLAPDGAVAKITGKEGTHFSGPARVFGSEEEAQQRINDGTVVSGDVVVIRYEGPRGGPGMREMLTPTSAIMGRGLGDEVALITDGRFSGGSHGFVVGHVTPEAFDGGPLALLENGDQITIDAEANTLVVALSDAELARRRANWQQPAPRYTRGVLAKYARLVGSASEGALTDLG

SEQ ID NO: 187 - DNA, 1713 bp, Chromohalobacter salexigens
atgagccagcaggactcccccgccaacgccgatcaccgtcgccgccattcctccatcgtggtcgacggccccggcaaggccgccagtcgcgccatgctgcgtgccgtcggtttcaccgacgaggatttcaagaagccgcaggtggggatcgcctcgacctggagtcgcgtcacgccgtgcaacagccacatcaacgtgttggccgatgccgccagtgacggcgccgacgccgccggtggcaagggcgtggtcttcaataccatcaccatcagcgacggcatcgccaacggcaccgaaggcatgaagtattcgatggcctcgcgcgagatcatcgccgattccatcgaggcggtctccggctgcgaggggttcgacggggtggtggccatcggtggctgcgacaagaacatgcccggctgcatgatcggcctggcacgtctcaaccggcccagcatcttcgtctacggcggtaccatccagcccggtgccgggcacaccgacctggtctcggtattcgaggcgatgggcgcctactcccagggcaacaagtcgctgatcgaggtcaagcagatcgaggaagtcgcgattcccgggccgggctcctgtggcggcatgtacaccgccaacaccatggcctcggcgatcgaggccatgggcatgagcctgcccaattcgtcggctcaggacgcggtatcccagagcaagaaggacgatagtcgcgccgccggcgaggccgtgctcaagctgctcgaactggacatcaagccctcggacatcatgacccgcaaggcgttcgagaacgccatcaccgtggtcatcgccctcggcggttccaccaatgccgtgctgcacctgattgccatggccaacaccatcggggtcgagctctcgctcgacgactttaccgagatcggcaagcgcgtcccggtgctcgccgacctgcgccccagcggtcattatctgatgagcgagctggtggcgatcggcggcattcagccgatgatgaagattctgctcgatgcggggctgctccacggcgattgcctgaccgtgaccggcaagacgctggccgagaacctggccgacgtgacgccttatccgacggggcaggaaatcatcaagccgctggaggcaccgatcaaatcgagcagccacctgcgcattctctacggcaacctggcgccagagggagcggtggccaagatcaccggcaaggaaggtacccgcttcaccgggcgtgctcgcgtgttcaactccgaggaggaggcccaggcgcgcatcaacgacctgaccgtggccgccggtgacgtcgtcgtgattcgctacgaggggccgaagggcggtcccggcatgcgcgaaatgctgacgccgacctcggcgatcatgggccgtggcctgggcgacaaggtggccttgatcaccgatggacgcttctccggcggcagccatggcttcgtggtcggtcacatcacgccggaagccttcgtcggcggccccatcggcctggtcgaggacggtgacgagatcaccatcgacgccgagaacgacatcatgacgctgcatatcgacgacgccgagatggcgcgccgccgtgcggcctggaagcgcccggcaccgcgttatacgcgcggcacgctggccaagtacgccaagacggtcagctcggcatcgaaaggggcggtcaccgatctgcccgaagcgctggacgattga

SEQ ID NO: 188 - protein, 570 aa, Chromohalobacter salexigens
MSQQDSPANADHRRRHSSIVVDGPGKAASRAMLRAVGFTDEDFKKPQVGIASTWSRVTPCNSHINVLADAASDGADAAGGKGVVFNTITISDGIANGTEGMKYSMASREIIADSIEAVSGCEGFDGVVAIGGCDKNMPGCMIGLARLNRPSIFVYGGTIQPGAGHTDLVSVFEAMGAYSQGNKSLIEVKQIEEVAIPGPGSCGGMYTANTMASAIEAMGMSLPNSSAQDAVSQSKKDDSRAAGEAVLKLLELDIKPSDIMTRKAFENAITVVIALGGSTNAVLHLIAMANTIGVELSLDDFTEIGKRVPVLADLRPSGHYLMSELVAIGGIQPMMKILLDAGLLHGDCLTVTGKTLAENLADVTPYPTGQEIIKPLEAPIKSSSHLRILYGNLAPEGAVAKITGKEGTRFTGRARVFNSEEEAQARINDLTVAAGDVVVIRYEGPKGGPGMREMLTPTSAIMGRGLGDKVALITDGRFSGGSHGFVVGHITPEAFVGGPIGLVEDGDEITIDAENDIMTLHIDDAEMARRRAAWKRPAPRYTRGTLAKYAKTVSSASKGAVTDLPEALDD

SEQ ID NO: 189 - DNA, 1677 bp, Marinobacter algicola
atgacagaagacaaacgccgccgttattccgcgcccgtggtcgatggcctgggcaagtcggcaagccgcgccatgttgcgggccgtggggtttaccgatgaagatttccgcaaaccccagatcggtattgcctcgacctggagcaacctgacgccctgcaatatgcacatcaaccaactggcggaggaatcggccgcgggtgccgacgaggccgggggcaagagcctgacgttcaataccatcaccgtttccgacggcatcgccaacggcacggagggtatgaagtactccctggtgtcgcgggaagtcattgccgactccattgaaaccgtggctggttgtgaaggttttgatggcctggttgccattggcggctgcgacaagaacatgcccggctgcatgatgggcctggcgcgcctgaaccggccgtcggtatttgtctatggcggcaccatcatgcccggcgagaatcacaccgacatcatctcagtatttgaggcggtgggtgcccatgcccggggtgacctggacctgattgaggtcaaacagatcgaggaaaccgcgattccggggccaggctcctgcggcggcatgtacaccgccaacactatggcctcggcgattgaagccatgggcatgagcctgccgggcagttccgcccagaacgctgtttccgagaccaaggcggccgactgcagggcggcgggcgcggccgtcctcaacctgctggagaaagatctcaagccatcggacatcatgacccgggaggcgttcgagaatgctatcaccgtggtaattgccctgggtggctccaccaacgcggtgctgcacctgattgccatggccagcaccgttggcgttgacttgacgctggacgacttcgtggaaatcggcaaacgggttcccgtattggcagatctgcgccccagcggtcactacatgatgtcggaactggtggcgatcggcggcattcagccgttgatgaagatgctgctcgaccgtggcatgctccatggcaactgcatgaccgtcaccgggcagacactggcggacaacctgaaagacgtggctccgtacccggcaagccaggacatcattcatgcctttgatgaccccatcaaggcggatagccatctgcgtatcctttacggcaacctggcgcctactggtgcggtggccaagatcactggtaaggagggtacccatttcaccggccgtgcacgggtgttccagtccgaggaagaggcccaggagcggatcatggacggcaccgttgtggccggagacgtgttggtgatccggtttgaaggccccaaaggtgggccgggcatgcgggagatgctaacgccgacttctgccatcatgggtaaagggctgggcagcgatgtggcgctgattaccgacgggcgtttttccggtggcagccacggtttcgtggttggtcatattacgccggaggccgcagaaggtgggccgattgcgctggtggaaactggcgacaccatcaccattgatgcagtggccaatcgcattgagctggatgtttcggagcaggaaatggagcgccgccgacaggcatggaccgcaccggctccccgatttacccgcggggtgctggccaaatacgcgcgcaccgtgagttccgcttcggaaggcgcagtgacagacaagccgtga

SEQ ID NO: 190 - protein, 558 aa, Marinobacter algicola
MTEDKRRRYSAPVVDGLGKSASRAMLRAVGFTDEDFRKPQIGIASTWSNLTPCNMHINQLAEESAAGADEAGGKSLTFNTITVSDGIANGTEGMKYSLVSREVIADSIETVAGCEGFDGLVAIGGCDKNMPGCMMGLARLNRPSVFVYGGTIMPGENHTDIISVFEAVGAHARGDLDLIEVKQIEETAIPGPGSCGGMYTANTMASAIEAMGMSLPGSSAQNAVSETKAADCRAAGAAVLNLLEKDLKPSDIMTREAFENAITVVIALGGSTNAVLHLIAMASTVGVDLTLDDFVEIGKRVPVLADLRPSGHYMMSELVAIGGIQPLMKMLLDRGMLHGNCMTVTGQTLADNLKDVAPYPASQDIIHAFDDPIKADSHLRILYGNLAPTGAVAKITGKEGTHFTGRARVFQSEEEAQERIMDGTVVAGDVLVIRFEGPKGGPGMREMLTPTSAIMGKGLGSDVALITDGRFSGGSHGFVVGHITPEAAEGGPIALVETGDTITIDAVANRIELDVSEQEMERRRQAWTAPAPRFTRGVLAKYARTVSSASEGAVTDKP

SEQ ID NO: 191 - DNA, 1677 bp, Marinobacter aquaeolei
atgacaaccgataaacgacgccgacactcggcaccggtggtagacggtatcaataaatccgccagccgggccatgctccgggcggtaggttttaccgacgaggatttccgcaaaccccagattggcattgcctccacctggagcaaccttacgccctgcaacatgcacattgacggcctggcccgggaggccgccaagggtgccgacggagccgggggcaagagcctgatcttcaacaccatcactatctctgatggcatcgccaacggcaccgagggcatgaaatattccctggtgtcgcgcgaggtgattgccgattccattgagaccgtggccggttgtgagggcttcgacggactggtcgccatcggtggctgcgacaagaacatgcccggctgcatgatgggcctggcccggctgaaccggccctcggtcttcgtttacggcggcaccatcatgcccggcgagaaccataccgacatcatctccgtgtttgaggcggtgggcgcccatgcccgcggtaacatggagctgatcgaagtcaaacagatcgaggaaaccgcgattcccgggccaggctcctgtggcggcatgtacaccgccaacaccatggcctccgccattgaggccatgggtatgagcctgccaggcagctcggcccagaacgccatctccgacagcaaactggcggattgcgaagccgcaggcgccgcggtgctgaaactgctcgaagccgatatcaagccctccgacatcatgacccgggaagcgttcgagaacgccatcaccgtggtggtcgcgctgggcggttccaccaacgccgtgctgcaccttctgggtatggccagtaccgtgggagtggagctgtcactggacgatttcgtacgcatcggcaaacaggtaccagtcctggcggaccttcgcccctccggccactacatgatgtccgagctggtggccattggtggcattcaaccgctaatgaagatgctgctcgaccgggggctgctgcatggagactgcctcacggtaaccggcaaaaccctggcagagaatctcgagaccgtggtgccctaccccgaagaccagcagatcatccacgccttcgacaacccgatcaaagccgacagtcatctgcgtattctctatggcaacctggctccggaaggctcggtggcgaaaatcaccggtaaggaaggcacgcatttttccggtcgagcccgagtgtttcactctgaagaggaagcccaggagcgaatcctggatggcaccgtggtcgctggcgacgtgctggtgatccgatacgaaggcccgaagggcgggcctggcatgcgggaaatgctcagccccacctcggcgattatgggcaaaggtcttggcagtgatgtggctctgattacagacggccgcttctccggtggcagtcatggttttgtggttggccatatcacaccagaggccgccgtgggcgggccgattgcgctggtagaagacggcgacaccattaccattgatgccgtgagcaactcgattgtgctggaaatctctgacgaggaaatggaaaaacggcgcaaagcctggacgccgccggaacccagatttacccggggcgtgctggccaaatatgcccgtgtggtgagctctgcatctacgggggccgttaccgacctgccctag

SEQ ID NO: 192 - protein, 558 aa, Marinobacter aquaeolei
MTTDKRRRHSAPVVDGINKSASRAMLRAVGFTDEDFRKPQIGIASTWSNLTPCNMHIDGLAREAAKGADGAGGKSLIFNTITISDGIANGTEGMKYSLVSREVIADSIETVAGCEGFDGLVAIGGCDKNMPGCMMGLARLNRPSVFVYGGTIMPGENHTDIISVFEAVGAHARGNMELIEVKQIEETAIPGPGSCGGMYTANTMASAIEAMGMSLPGSSAQNAISDSKLADCEAAGAAVLKLLEADIKPSDIMTREAFENAITVVVALGGSTNAVLHLLGMASTVGVELSLDDFVRIGKQVPVLADLRPSGHYMMSELVAIGGIQPLMKMLLDRGLLHGDCLTVTGKTLAENLETVVPYPEDQQIIHAFDNPIKADSHLRILYGNLAPEGSVAKITGKEGTHFSGRARVFHSEEEAQERILDGTVVAGDVLVIRYEGPKGGPGMREMLSPTSAIMGKGLGSDVALITDGRFSGGSHGFVVGHITPEAAVGGPIALVEDGDTITIDAVSNSIVLEISDEEMEKRRKAWTPPEPRFTRGVLAKYARVVSSASTGAVTDLP

SEQ ID NO: 193 - DNA, 1692 bp, Marinobacter sp.
atgagtgataccccccaagaccctcgccgccgttattccgctccggttgtggacggtgtggctaaatccgccagtcgttccatgctgagggccgtcggttttaacgacgaagatttcagcaaaccgcagatcggcattgcttccacctggagtatggttaccccctgtaatagccacattaacgagctggccgacattgcttgtaagggtgcggaccaggccggtggtaaaggcgttatttttaacaccattacgatttctgacggcattgccaacggcaccgaaggaatgaagtattccctggtgtcgcgggaagtcatcgcagattccattgaaaccgtggccggttgcgagggttttgacggcctggttgccattggcggctgtgacaaaaacatgcccggctgcatcatgggcctggcgcggcttaaccggcccagcgtgtttgtttatggcggtactattttgcctggtgaaggtcacaccgacattatttcagtgtttgaagcggtgggcgcccatgccaaaggcgaactgtcgttgattgaagtgaagcatattgaagaaaccgccattcccggccccggttcctgtggcggcatgtacaccgccaataccatggcctcggccatagaagcactgggtatgagcctgcccggcagctcggcgcagaatgcggtgtcgaatgacaaaaaagccgattgcgaagccgccggtgccgcggtcatgaatctgttggatcgagatatcaaaccttccgacattatgactcagcacgcctttgagaacgccatcactgtgatcatcaccttgggtggttccaccaacgccgtactgcacctgattggtatggccaacacggcgggtgtagagctaaccctggatgacttcactcgcattggtaaaaaggttccattgttggcggatctgcgccctagcggccattacatgatgagcgaattggtggccattggcggcatccagccactcatgaaaatgctgctagacgccggcatgctccacggcgattgcctgacagtaaccggcaaaactctggccgaaaacctggccacggtagaaccttatgccgatggccagaaaatcattatgcctctggaccagcccattaaagcggaaagccacctgcgcattctgtttggtaatctggcgccggaaggctccgtggcaaaaattaccggtaaggaaggcacccactttaaaggtcgggcgcgggtgtttggttcggaagaagaagcccaagcacgaattctggacggcactgtggtggctggcgatgtgctggttatccgctatgaaggcccacgcggcggccccggcatgcgcgaaatgctgtcacccacctcggcgattatgggccgtgggctgggcagcgatgtggctttgataactgacggtcgtttctccggtggtagccacggcttcgtcgtaggccacattacgccggaagcgtttgatggcggccctattgccttggtgcaagacggcgacgaaatcgtgattgatgccgtggccgacactattgagctaaatgtcagtgacgacgaactgcagagccgtcgcgacgcctggcagcaaccgcaaccgcgttacacccgcggtgtgttagccaagtatgcgcgcaccgtgagttcggcgtcgaccggtgcagtgaccgacctgcccgagccttga

SEQ ID NO: 194 - protein, 563 aa, Marinobacter sp.
MSDTPQDPRRRYSAPVVDGVAKSASRSMLRAVGFNDEDFSKPQIGIASTWSMVTPCNSHINELADIACKGADQAGGKGVIFNTITISDGIANGTEGMKYSLVSREVIADSIETVAGCEGFDGLVAIGGCDKNMPGCIMGLARLNRPSVFVYGGTILPGEGHTDIISVFEAVGAHAKGELSLIEVKHIEETAIPGPGSCGGMYTANTMASAIEALGMSLPGSSAQNAVSNDKKADCEAAGAAVMNLLDRDIKPSDIMTQHAFENAITVIITLGGSTNAVLHLIGMANTAGVELTLDDFTRIGKKVPLLADLRPSGHYMMSELVAIGGIQPLMKMLLDAGMLHGDCLTVTGKTLAENLATVEPYADGQKIIMPLDQPIKAESHLRILFGNLAPEGSVAKITGKEGTHFKGRARVFGSEEEAQARILDGTVVAGDVLVIRYEGPRGGPGMREMLSPTSAIMGRGLGSDVALITDGRFSGGSHGFVVGHITPEAFDGGPIALVQDGDEIVIDAVADTIELNVSDDELQSRRDAWQQPQPRYTRGVLAKYARTVSSASTGAVTDLPEP

SEQ ID NO: 195 - DNA, 1680 bp, Pseudoalteromonas haloplanktis
atgacttctgaaaaaccacgtaaatattcacaaaaaattgtagatggtagcgctcaggctcctagtcgttctatgttacgagcggtaggttttaatgatgacgattttaaaaagtctcaagttggtattgcctctacatggtctatggtaacgccgtgcaatatgcacattaatacacttgccgaagaagtaggtaaaggcgtagatagcgccggtgcgaaaagcgttatatataataccattaccgtatccgatggtatttctatgggcaccgaagggatgaaatattctttagtatcacgcgaagtaatttgcgactcaatagaagcggtatcggcgggtatgggccacgacggtattattgctattggcggttgtgataaaaatatgccgggttgtttaatgggtttagcacgtttaaaccgcccctctatatttgtgtacggcggtacaattttacccggtgaaaatcataccgatatagtctcggtatttgaagcggtgggcagctacgcggcaggcgatattccaattacgcaattagaacatattgaaaaaacagccataccaggggctggttcgtgtggtggtatgtacacggcaaatacgttagcctcagcaattgaagctttaggcatgagtatgccaaatagttctgcgcaaaatgctatttcacaaaacaaaaaacaagactgtattgatgcgggtaaagcgattgtttatttgctagagcatgacattaaaccttccgatattatgaccaaaaaagcgtttgaaaatgcaattacgctgatcattaccttaggcggctcaaccaatgcggtgctgcatttaatcgctatggctgatgcggtaggcgttgaagtaacattggatgactttgtgcgtattggcgataaaacaccagtaattgccgacttgcgtcccagcggtcaatatttaatgtcggagttgattgaaattggtggcattcaaccactgatgaagcgtttattagatgccggtatgctgcacggtgactgtatgacagtgacaggcaaaaccatggccgaaaatttagccgatgtagcagattacccagcagggcaaaatattattttaccttttgataagccgattaaaaaagacagccatttagttatattagctggtaatttagcgccagaaggggcagtgtcaaaaattacgggtaaagagggtttacgctttaccggcaacgcaaaagtatatgactcagaagagcaaggttttgccgctattatagatgggcaagtagtagccggagacgttgtagtaattcgctatgaaggccctaaaggtggcccaggtatgcgtgaaatgctaagccccacttcagctattatgggtaaaggtttaggtaacgatgtggcgcttattaccgatggtcgtttttcaggtggtagtaggggttttgttgtggggcacgttacaccagaagcttacgaaggcggcgccattgcactagtagaaaatggtgacagcattactattgacgcgcaaagccgtgaaatgactcttaatattactgatgaagaaatggccagtaggaaacaacgttggcaacaacctgcgccaaaatacacccgcggattactagcaaaatatgccagaacagtaagttcagcttctaccggagccgtgaccgataagccaagttaa

SEQ ID NO: 196 - protein, 559 aa, Pseudoalteromonas haloplanktis
MTSEKPRKYSQKIVDGSAQAPSRSMLRAVGFNDDDFKKSQVGIASTWSMVTPCNMHINTLAEEVGKGVDSAGAKSVIYNTITVSDGISMGTEGMKYSLVSREVICDSIEAVSAGMGHDGIIAIGGCDKNMPGCLMGLARLNRPSIFVYGGTILPGENHTDIVSVFEAVGSYAAGDIPITQLEHIEKTAIPGAGSCGGMYTANTLASAIEALGMSMPNSSAQNAISQNKKQDCIDAGKAIVYLLEHDIKPSDIMTKKAFENAITLIITLGGSTNAVLHLIAMADAVGVEVTLDDFVRIGDKTPVIADLRPSGQYLMSELIEIGGIQPLMKRLLDAGMLHGDCMTVTGKTMAENLADVADYPAGQNIILPFDKPIKKDSHLVILAGNLAPEGAVSKITGKEGLRFTGNAKVYDSEEQGFAAIIDGQVVAGDVVVIRYEGPKGGPGMREMLSPTSAIMGKGLGNDVALITDGRFSGGSRGFVVGHVTPEAYEGGAIALVENGDSITIDAQSREMTLNITDEEMASRKQRWQQPAPKYTRGLLAKYARTVSSASTGAVTDKPS

SEQ ID NO: 197 - DNA, 1686 bp, Acinetobacter sp.
atgagtaaagacaatatacgccagtattcggcaccagtttatgacggtattgaaaatgcccctgcacgttcgatgatgcgtgctgtgggctttcaagataaagattttaatcgtccatttattggcattgcttcaacatgggccaatgtcacgccgtgcaacatgcacattgatggactggcacgagaagctgaacatggggtgaatcaggccagcggtaagggaattatttttaacactattaccatttctgacggtatttcaaacggtaccgaaggcatgaagtattctttggtttctcgtgaaattattgcagactctattgaggcggtcattggttgtcagggttacgatggtgtaattgccattggtggctgcgacaaaaacatgcctggctgtattatggggctggcacgtttgaaccgtccaggcttgtttatttatggcggcaccattcaaccaggtgaaggacataccgacatgatttcggtgtttgaagcggtgggacagtacgccaaaggagaaatcaatgccattcaggtcaagcagattgaagaagtcgctttaccaggaccaggttcttgcgggggaatgtataccgccaataccatggcttctgctattgaagcactgggaatgagtttaccaggttcttctgcacaggatgccatttctgaagaaaagcgtcaggactgtcatcgtgcgggcgaggcggtgatgaacctgcttcggctggatattcgtccacgcgatattatgaccaaagcggcatttgagaatgccattaaggtcgtcattgctttgggcggttcaaccaatgccgtattgcatttgattgcaatggcacatacggctgaggtaaagcttgatctggatgattttgtacgaattggtcaggaaacacctgtggtggcagatttacgaccatcgggtaagtatctcatgtccgaactgatcaagattggtgggattcagccgttgatgaagcgaatgctggaacgcggcatgctggatggtagttgtctgactgtaactggtaagacccttgcagagaatttggccgaggttgaggattatcctgccgatcaacaaattatcttgccatttgagcaacctgttaagaaagactcccatctagtgattcttaagggtaatttgtccccgacaggtgccgttgccaaaattacgggcaaagaaggtttatattttgaagggccagcccgcgtttttgaaggcgaagaaggcgccatgcgtggcattctagacggagaagtacaagagggcgaagttgtcgtcattcgtggtgaaggacccaaaggtggaccaggcatgcgcgaaatgctgaaaccaacgtctgcaattattggtaaaggactgggacaatcggtggcgctgattaccgatgggcggttttcgggcggcagtcatggctttgtcattggccatgtgaccccagaagcttacgaaggtgggcctattggtttggttgaaaatggtgataaaatttcaatcaatgctgaaacgcgtgaaatcaccttacatatttctaacgaagaaatgagcttacgtcgtgcaaaatggcagaaaccagaaccaaaatataaatctggtgctttggcaaaatttgcaaaacttgcagcaggtgcggacaaaggcgcagttactgatttaaatcttgatgtgtaa

SEQ ID NO: 198 - protein, 561 aa, Acinetobacter sp.
MSKDNIRQYSAPVYDGIENAPARSMMRAVGFQDKDFNRPFIGIASTWANVTPCNMHIDGLAREAEHGVNQASGKGIIFNTITISDGISNGTEGMKYSLVSREIIADSIEAVIGCQGYDGVIAIGGCDKNMPGCIMGLARLNRPGLFIYGGTIQPGEGHTDMISVFEAVGQYAKGEINAIQVKQIEEVALPGPGSCGGMYTANTMASAIEALGMSLPGSSAQDAISEEKRQDCHRAGEAVMNLLRLDIRPRDIMTKAAFENAIKVVIALGGSTNAVLHLIAMAHTAEVKLDLDDFVRIGQETPVVADLRPSGKYLMSELIKIGGIQPLMKRMLERGMLDGSCLTVTGKTLAENLAEVEDYPADQQIILPFEQPVKKDSHLVILKGNLSPTGAVAKITGKEGLYFEGPARVFEGEEGAMRGILDGEVQEGEVVVIRGEGPKGGPGMREMLKPTSAIIGKGLGQSVALITDGRFSGGSHGFVIGHVTPEAYEGGPIGLVENGDKISINAETREITLHISNEEMSLRRAKWQKPEPKYKSGALAKFAKLAAGADKGAVTDLNLDV

SEQ ID NO: 199 - DNA, 1737 bp, Opitutaceae bacterium
atgaagccgacgaccgccaagaccaagcctgccacagccgccaagaccgccaacgccacgcgccagttctcctccatcgtgcacgacggagccgaccgcgcccccaatcgctccatgctccgcgccgtcggattcggcgatgcggatttcaagaaaaccgtcgtcggcgtcgcctccacctggtcgatgctcaccccgtgcaacatgcacatcaacaagctcgccgaatacgccgagcagggcgccaacgaagccggcggcaagggcatcatcttcggcaccatcaccatcgccgacggcatcagcatgggaacgcccggcatgcgctactcgctcgtgtcccgcgaagtcattgccgactccatcgaaaccgtggttggcggcgaaggttttgacggccttgtcgccatcggcggctgcgacaaaaacatgcccggctgcgttatggccatggcccgtctcaaccgccccagcgttttcgtttacggcggcaccattcttcccggcatccacccggaaaccaaaaaggacctcgacatcgtttccgtcttcgaagccgtcggccagcacgccgcgggcaagatcaacgacgctgcgctcaaggttgttgaggaatgctccatccccggtcccggttcctgcggcggtatgtataccgccaatacaatggccaacgccatcgaagccctcggcctctcgctgcccaattcctccgcgcaaatcgccatctccaaggaaaaacaagaagactgtcgccgcgccggagccgctgtcgttgaactcgcaaaaaaggggattcgtccgcgtgacattttaaccaaaaaagcctttgaaaacgccatcactgtagtgatcgccctcggtggctcaaccaatgccgtcctgcacctcctcgccatcgcgcacactgccggcgtgaagctcaccatcgacgacttcacccgcatcggcaaacgcgtgcccgtgctcgccgatctcaaaccttcgggcaaatacggcatggtgcatctctctcgcatcggcggcgtgcctccgctcatgaagaccttgctcgaccgcggtctcatccacggcgactgcctcaccgtcaccggcaagaccgtggcggaaaacctcaaggacgtgcagccgtatccagaaaatcaggacgtgatccgtccctttgaccaaccgatcaagcccgacagccacctgcgcattctctacggcaacctcgccgccgagggttccgtggccaagatctccggcaaggaaggcttaaagttttccggcaaagccatcgtgttcgagggagaggaggccgcgttgtctgccatcctcgacggacgcgtgaagtccggccacgtcgtcgtgatccgcaatgagggtcccgtgggcggccccggcatgagggagatgctcgcccccaccagcgccatcatgggcaagggactcggcaaggaagtcgcgctcatcaccgacggacgtttttcgggcggttcgcacggatttgtggtcggccacatcacacccgaggcggcgattggcggcaccatcggcgtcgtgaaaaacggcgacccgatcaccatcgacgccgtaaaaaaccagatcacgctcgacattcccgcgaaggaaatcgccgcgcgcaaaaagacctggaagccacgcaagccctacaccaatcgcggtgtgttggcgaagtatgccaaactcgtcagcaccgccagcgaaggcgcggtgacggacaagtatttgtaa

SEQ ID NO: 200 - protein, 578 aa, Opitutaceae bacterium
MKPTTAKTKPATAAKTANATRQFSSIVHDGADRAPNRSMLRAVGFGDADFKKTVVGVASTWSMLTPCNMHINKLAEYAEQGANEAGGKGIIFGTITIADGISMGTPGMRYSLVSREVIADSIETVVGGEGFDGLVAIGGCDKNMPGCVMAMARLNRPSVFVYGGTILPGIHPETKKDLDIVSVFEAVGQHAAGKINDAALKVVEECSIPGPGSCGGMYTANTMANAIEALGLSLPNSSAQIAISKEKQEDCRRAGAAVVELAKKGIRPRDILTKKAFENAITVVIALGGSTNAVLHLLAIAHTAGVKLTIDDFTRIGKRVPVLADLKPSGKYGMVHLSRIGGVPPLMKTLLDRGLIHGDCLTVTGKTVAENLKDVQPYPENQDVIRPFDQPIKPDSHLRILYGNLAAEGSVAKISGKEGLKFSGKAIVFEGEEAALSAILDGRVKSGHVVVIRNEGPVGGPGMREMLAPTSAIMGKGLGKEVALITDGRFSGGSHGFVVGHITPEAAIGGTIGVVKNGDPITIDAVKNQITLDIPAKEIAARKKTWKPRKPYTNRGVLAKYAKLVSTASEGAVTDKYL

SEQ ID NO: 201 - DNA, 1683 bp, Flavobacterium sp.
atggaattaaataaatacagtaaaactgtaactcaagacccaacattgcctgcggctcaagcaatgctgcacgcaataggtttaaccgatgaagatctcaagaaaccattaattggtatcgcaagtactggttatgaggggaatccttgtaatatgcaccttaatgatttggcaacctacgtcaagaaaggtgcgtctaatgcagatttagtcggacttattttcaatacgatcggtgtaagtgatggtatttctaacggaactccgggaatgcgtttctcgctgccgtcacgtgatatcatcgctgattctatggaaaccgtggttcaagcaatgagttatgacggtctggttacagttgtgggctgtgataaaaatatgccgggggcattaattgcgcaattgcgattaaatcgcccgtcaattttagtttatggaggaacgatcgcttccggatgccataacggaaaaaaactagatatcatttctgcttttgaggcttatggtcaaaaagttgcaggaactattgatgataatgagtttaaagaagtagtacacaaagcgtgtccgggtgccggtgcttgtggtggtatgtatactgcaaatactatggcttctgctattgaagctttaggaatgtcattgccttttaactcatcgaaccctgcagttactgatgctaatattaaagagcaggaatgtattaaagcaggtgaggctttaaaatatttattagagcaggatattaaaccttcagatattgtaacaaaagagtcgctcgagaatgcgattcgcttggtgactgttttgggaggttctaccaacgcagtattgcactttttagcaatagctaaagcagctcaggtagattttacgctagaagattttcagcgcctgagtgataatacaccgttgttagcagatcttaaaccttcaggtaaatattctatggaagatttacacggtgttggcggaattccgggagtattaaaatatatgcttgataacggtatgcttcacggggattgtttaaccgttaccggaaaaactttagctgaaaacctaaaagatgttcccaatcttatagatggtcaggatattattagaccgttgaataagccaattaaagatagtggccatatccgtatactattcgggaacttggctactgaaggagctgtagcaaagattaccggtaaggaagggctttcgtttacaggaactgccaatgtattcaacagcgaattagaggtaaacgaaggaattaaatcaggaaaagttaaaaaaggtgacgtagtgatcattcgctatgaaggacctaaaggtggtcccggaatgccagaaatgcttaagcctacctcttcaattatgggagccggtttaggtaaagacgttgctttgattactgacggaagattctctggtggatcgcacggatttgtggtggggcacgtttctcccgaagcacaagtgggtggaaatatcgcacttgtagaaaatggagatgtcatttctattgatgccgtaaagaataccatcaacatcgatattaccgatgaagaattggcaaaacgaagagaaaaatggacagctccggaacttagattccaacgcggagcgttatataaatatgcgaaaacagtctcgtcagcttctaaaggttgtgtgacagacgaaatgtag

SEQ ID NO: 202 - protein, 560 aa, Flavobacterium sp.
MELNKYSKTVTQDPTLPAAQAMLHAIGLTDEDLKKPLIGIASTGYEGNPCNMHLNDLATYVKKGASNADLVGLIFNTIGVSDGISNGTPGMRFSLPSRDIIADSMETVVQAMSYDGLVTVVGCDKNMPGALIAQLRLNRPSILVYGGTIASGCHNGKKLDIISAFEAYGQKVAGTIDDNEFKEVVHKACPGAGACGGMYTANTMASAIEALGMSLPFNSSNPAVTDANIKEQECIKAGEALKYLLEQDIKPSDIVTKESLENAIRLVTVLGGSTNAVLHFLAIAKAAQVDFTLEDFQRLSDNTPLLADLKPSGKYSMEDLHGVGGIPGVLKYMLDNGMLHGDCLTVTGKTLAENLKDVPNLIDGQDIIRPLNKPIKDSGHIRILFGNLATEGAVAKITGKEGLSFTGTANVFNSELEVNEGIKSGKVKKGDVVIIRYEGPKGGPGMPEMLKPTSSIMGAGLGKDVALITDGRFSGGSHGFVVGHVSPEAQVGGNIALVENGDVISIDAVKNTINIDITDEELAKRREKWTAPELRFQRGALYKYAKTVSSASKGCVTDEM

SEQ ID NO: 203 - DNA, 1680 bp, Cellulophaga sp.
ttgaaagaacttaataaatatagtaaagcggtaactcaagatcctacgcagccagctgctcaggcaatgttgcacgctataggacttacagatgaagattttaaaaagccacttgtaggtattgcaagtacaggttatgagggtaatccttgtaatatgcacttaaataaccttgcactagatattaaaaaaggagtacaaacttctgatctggtaggtcttatttataataccataggtgtaagtgacggtatctcaatgggtactcctggtatgcggtactcactacctagtagagatattattgcagactcaatggagactgtagtacaagctatgtcttatgatgcactggttacagtggtaggttgtgataaaaatatgccgggtgctcttatggcacagcttaggctagatagaccatctatactcgtctatgggggaactatagcaccaggatttcacgaagataaaaagctagatgtagtgtctgcttttgaagcttggggagaaaaagtagctggtagtattacagagcaagagtttaaaacggtggtaaaaaaagcctgtccaggtgctggtgcgtgtggtggtatgtatactgcaaacacgatggcaagcgcgattgaggcactagggatgagcttaccctatacaagttctaaccctgcagtgtcacctaataaaactgcggagtgtgctagagtaggagctgctttaagaaacctaatagaaaaagacataaaaccctcagacattgttactcgcaagtcactagagaatgcggtgagacttgtaaccgtacttggaggatctactaatgctgtgctgcactttctcgctatagcaaaggctgcacaagtatcatttacactagaagattttcaaaaaataagcgacaccacaccttttctagcagatcttaaaccatcaggaaaataccttatggaagatttacataatgtaggaggagtgccgggcgtattaaagtatatgctagagcaaggtatgttgcacggtgactgtatgaccgtaactggtaaaactattgcagagaatctagcagttgtagaccatcttcaggcacatcaagatgttattcattcggttgagaatcctattaaagagacgggacacattcgtattctttatggaaatattgcaagtgaaggatctgtggcaaaaattacaggtaaagagggattacattttcgcggaagcgcaagagtttacaacggtgagtatgctgcaaacgcgggtataggtgcaggagaggtgaaaaagggtgatgtagtagttatacgctacgaagggccacaaggaggaccgggtatgccagaaatgctcaaacctacagcggctattatgggtgctggcttaggtaaggatgtggcacttattacagatggacgtttttctggaggtacacacggctttgttgtggggcacattactccagaggctcaagtaggtggtgggattgcgcttatagaaaatggagataccattgtgattaacgctgagactaacacaattaatgttgagataagtgagagcgaactagaagcacgtaaaaagaactgggtagctccagagcttaaagtaaaacgtggctcactttataaatatgctcgtatggtctcatctgcgagtgagggatgcgtgacagacgagttctag

SEQ ID NO: 204 - protein, 559 aa, Cellulophaga sp.
MKELNKYSKAVTQDPTQPAAQAMLHAIGLTDEDFKKPLVGIASTGYEGNPCNMHLNNLALDIKKGVQTSDLVGLIYNTIGVSDGISMGTPGMRYSLPSRDIIADSMETVVQAMSYDALVTVVGCDKNMPGALMAQLRLDRPSILVYGGTIAPGFHEDKKLDVVSAFEAWGEKVAGSITEQEFKTVVKKACPGAGACGGMYTANTMASAIEALGMSLPYTSSNPAVSPNKTAECARVGAALRNLIEKDIKPSDIVTRKSLENAVRLVTVLGGSTNAVLHFLAIAKAAQVSFTLEDFQKISDTTPFLADLKPSGKYLMEDLHNVGGVPGVLKYMLEQGMLHGDCMTVTGKTIAENLAVVDHLQAHQDVIHSVENPIKETGHIRILYGNIASEGSVAKITGKEGLHFRGSARVYNGEYAANAGIGAGEVKKGDVVVIRYEGPQGGPGMPEMLKPTAAIMGAGLGKDVALITDGRFSGGTHGFVVGHITPEAQVGGGIALIENGDTIVINAETNTINVEISESELEARKKNWVAPELKVKRGSLYKYARMVSSASEGCVTDEF

SEQ ID NO: 205 - DNA, 1680 bp, Kordia algicida
atgaacaatctcaataaatacagcaaaacagtcacacaagatcctacgcaacctgcggcacaagccatgttgcatgccattggattaacgaaagaagactttttcaaacccatcatcggaattgcaagtacaggttacgaaggaaatccgtgcaacatgcacctaaacgatctggcaaaactggcaaaacaaggaacaaaaaatgaggaggttgtcggacttattttcaatacaattggcgtaagtgatggaatctccatgggaacaccaggaatgcgttattcattgccttcacgcgatatcattgccgattctatggaaacggtagtgcaagcaatgagttatgacggattaatcacggttgttggttgtgacaaaaacatgccaggcgcactaatggcaatgattcgcctaaatcgcccaagtatcttagtctatggcggaaccattgattctggttgtcacaacggaaaaaaactcgatgttgtttctgcttttgaagcttggggaagcaaagttgcaggaactatggacgaaacagaataccaaaacattgttgaaaaagcgtgtccaggtgctggtgcttgtggcggaatgtacaccgcaaacaccatggcttctgctatagaagcattgggaatgacattaccattcaattcatcaaatcctgcgttgagcgatgctaaaaaacaagaatcggttgcggcgggcgaagcaatgcgtgttttgttagaaaaagatatcaaaccatcagacattattactcgaaaatctttggaaaatgcagttcgtttagtaacaattttgggcggatcaaccaatgcagtattacacttcttagcaattgccagagctgcacaaattgatttcacactcaaagactttcaagaaataagcgatgaaacgccgtttttggcagacttaaaacctagtggaaaatacttaatggaagacgtacacgctgtcggcggaattcctgcggtattaaaatatttactcaaaaaaggattgcttcatggcgattgtttaacggttacgggaaaaacaatggcagaaaatttattagatgtcgatgacttaacagaaggtcaagatgtcatcaaacctgtggaaaatccaataaaaatatcaggacacttacgcatgctttatggaaacctagcaagtgaaggaagcgtggcaaaaatcacaggaaaagaaggtttaaaattctctggaaaagcaaaagtatttgaaggtgaatacgaagccaatgacggaattcgtgatggaaaagtgcaaaaaggagacgtcgtcgtcattcggtatgaaggaccaaaaggcggaccaggaatgccagaaatgctaaagccaacagcagcaatcatgggtgcaggtttaggaaaagatgttgcattaattactgatggacgcttttctggaggaacacacggttttgtcgtcggacacatcacgccagaagcacaagaaggcggaacacttgctttagtaaaagatggcgatatcattaccattgatgcagaaacgaatacgatacaattagaagtttcaaacgaagaacttcaagaacgtaaaaaacaatggaaagcacccgaactcaaatttgaacgcggtgtattatacaaatatgcaaaaacagtttcatctgcatccaaaggttgcgtaactgatgaattttag

SEQ ID NO: 206 - protein, 559 aa, Kordia algicida
MNNLNKYSKTVTQDPTQPAAQAMLHAIGLTKEDFFKPIIGIASTGYEGNPCNMHLNDLAKLAKQGTKNEEVVGLIFNTIGVSDGISMGTPGMRYSLPSRDIIADSMETVVQAMSYDGLITVVGCDKNMPGALMAMIRLNRPSILVYGGTIDSGCHNGKKLDVVSAFEAWGSKVAGTMDETEYQNIVEKACPGAGACGGMYTANTMASAIEALGMTLPFNSSNPALSDAKKQESVAAGEAMRVLLEKDIKPSDIITRKSLENAVRLVTILGGSTNAVLHFLAIARAAQIDFTLKDFQEISDETPFLADLKPSGKYLMEDVHAVGGIPAVLKYLLKKGLLHGDCLTVTGKTMAENLLDVDDLTEGQDVIKPVENPIKISGHLRMLYGNLASEGSVAKITGKEGLKFSGKAKVFEGEYEANDGIRDGKVQKGDVVVIRYEGPKGGPGMPEMLKPTAAIMGAGLGKDVALITDGRFSGGTHGFVVGHITPEAQEGGTLALVKDGDIITIDAETNTIQLEVSNEELQERKKQWKAPELKFERGVLYKYAKTVSSASKGCVTDEF

SEQ ID NO: 207 - DNA, 1680 bp, Flavobacteriales bacterium
atgagtcaattaaacaaatacagtaaaactgttacacaagatccaacgcagccagctgctcaagcaatgcttcatgctattggattaactaaagaagatttttataaacctattgtaggaattgcaagtacaggttacgaaggtaacccttgtaatatgcacctcaatgacctagcgaaattggtcaaagaaggcacaaagaatgaagatgtcgtcggcttaattttcaacacaattggtgtaagtgatggcatttctatgggaacaccaggaatgcgttactcattaccttcaagagatattattgcagattctatggaaactgtagtacaagccatgagttatgatggtttagtcactgtagttggttgcgacaagaatatgcctggagccttaatggctatgataagattaaatcgtccttcgattttagtttatggaggcacaattgattctggttgtcataatgggcaaaaattagatgttgtttctgcatttgaagcttggggaagcaaagttgcaggtactatgaccgaaaatgaataccaaaatatagttgaaaaagcatgtcctggagctggtgcttgtggaggtatgtacacagcaaacacaatggcttctgctattgaggctctaggtatgacattaccttttaactcttctaatccagccttaagtgatgcaaagaaagaagagtctgtaaaagctggagaagctttaagagttttactcgaaaaagatattaagccttcagatattataactagaaaatcacttgaaaatgcagtaagattagttaccatattaggtggctctacaaatgctgtattacactttttagccattgcaagagcagctcaaattgatttcacattaaaagattttcaagatataagtgataacactccattcttagcagatttaaaaccaagtggaaaatacttaatggaagatgtacatgctgtaggaggaattcctgcggtattaaaataccttcttaaaaaaggattaattcacggagattgtttaaccgttaccggaaagacaatagctgagaatttattagatgttgctgacttaaccgaaggtcaagacgtcatcaaacccatcgaagaaccaattaaaatttctggacacttaagaatgctctacggaaacctagccactgaaggtagtgttgcgaaaattactgggaaagagggcttaagttttaaagggaaagcaaaagtatttgaaagtgaatatgatgcaaacgatggcattagagatggaaaagtagaaaaaggtgatgtcgtagtcattcgatacgaaggtccaaaaggagggcctggaatgccagaaatgctaaagccaactgctgctattatgggagctggtttaggtaaagatgtagccttgattactgatggaagattctctggaggaactcacggttttgtcgttggacacatcacacctgaagcacaagaaggcggcactcttgcttttgttgaagatggagatattattacaattgatgccgaaaccaatacgatttcagtagaagtatctgaacaagaattacaaaaaagaagaaaaaattggaaagctccagatttaaaatttgaacgtggagtactttataaatatgcaaagacagtatcatcagcttcaaaaggctgtgttactgatgaattttaa

SEQ ID NO: 208 - protein, 559 aa, Flavobacteriales bacterium
MSQLNKYSKTVTQDPTQPAAQAMLHAIGLTKEDFYKPIVGIASTGYEGNPCNMHLNDLAKLVKEGTKNEDVVGLIFNTIGVSDGISMGTPGMRYSLPSRDIIADSMETVVQAMSYDGLVTVVGCDKNMPGALMAMIRLNRPSILVYGGTIDSGCHNGQKLDVVSAFEAWGSKVAGTMTENEYQNIVEKACPGAGACGGMYTANTMASAIEALGMTLPFNSSNPALSDAKKEESVKAGEALRVLLEKDIKPSDIITRKSLENAVRLVTILGGSTNAVLHFLAIARAAQIDFTLKDFQDISDNTPFLADLKPSGKYLMEDVHAVGGIPAVLKYLLKKGLIHGDCLTVTGKTIAENLLDVADLTEGQDVIKPIEEPIKISGHLRMLYGNLATEGSVAKITGKEGLSFKGKAKVFESEYDANDGIRDGKVEKGDVVVIRYEGPKGGPGMPEMLKPTAAIMGAGLGKDVALITDGRFSGGTHGFVVGHITPEAQEGGTLAFVEDGDIITIDAETNTISVEVSEQELQKRRKNWKAPDLKFERGVLYKYAKTVSSASKGCVTDEF

SEQ ID NO: 209 - DNA, 1704 bp, Psychroflexus torquis
ttgatttttgaaaatgaaacagatacaatggaactaaataagtatagcaaaaccgttactcaagatcctactcaaccagctgctcaagctatgctgcatgctataggtctaactaaagaagatttttttaagcctatcattggtattgctagtactggatacgaagggaatccttgtaatatgcatttaaacgatctcgctaaactcgctaaacaagggacagcaaatgaagatattataggtttaatatttaataccataggggtgagtgatggaatttctatgggcacaccaggaatgcgttactctctaccttctagggatatcatcgcagactccatggaaactgttgttcaagctatgagttatgatggtttaattactgtcgtaggctgcgataaaaacatgcccggtgcattaatagcgatgattcgactcgacagaccttgcattatgatttatggaggaaccatcgattctggttgtcataatggaaaaaaattggacgtggtttccgcttttgaagcttggggaagtaaagtggctggaaccatgcaagaagaagaataccaaagcattgtagaaaaagcgtgtcctggagctggtgcttgtggagggatgtatactgctaatacgatggcctcttctatagaagctttaggaatgactttaccttataattcttccaatccagcgcttagtccagaaaaaaaacaagagtctattaaagcaggtgaagctttgagagttttattggaaaaagacatcaaaccttcagatataattacaagaaaatctttagaaaatgccatacggttaattacaattttaggaggatctacaaatgctgttttacattttttagcaattgctagagccgctgaaattgatttcactttaactgattttcaaacgattagcgataatactccttttttagcagacttaaaaccgagtggtaagtaccttatggaagatttacatgaggtaggtggaattccagcagttttgaaatatttgcttaaaaaaggccttatttatggagactgcctaaccgttacaggaaaaactttagcagaaaatttacgtgatgtagaggatcttaaagaaggtcaggaggtcatcaaaccaatagaaagccctattaaaatctcaggacatctaagaatgctctttgggaatttagctgaagagggcagtgttgctaaaattacaggaaaagaaggtttaaaatttcgaggaaaggccaaggtttttgaaggggaatacaaagctaatgacggaattagagatggaaaagttcaaaaaggagatgtagtggttatccgttatgaaggccctaaaggaggtccaggtatgccagaaatgctgaaacctactgctgcaataatgggagcagggttaggcaaagatgtcgctttgattaccgatggaagattctctggaggaactcatggttttgtagttgggcatatcactccagaagcccaagaaggcggcacgattgcccttgttgaagaaggggattatatcactattgatgccgagacaaacagtatcaatttagaagtatctgatgaggagctcatcaaaaggaaaaaaaattggaaggcaccaaatttaaaatttaaacgaggtgttctttataaatatgcgagaatggttaattctgcatcaaaagggtgcgtaacagacgaattttaa

SEQ ID NO: 210 - protein, 567 aa, Psychroflexus torquis
MIFENETDTMELNKYSKTVTQDPTQPAAQAMLHAIGLTKEDFFKPIIGIASTGYEGNPCNMHLNDLAKLAKQGTANEDIIGLIFNTIGVSDGISMGTPGMRYSLPSRDIIADSMETVVQAMSYDGLITVVGCDKNMPGALIAMIRLDRPCIMIYGGTIDSGCHNGKKLDVVSAFEAWGSKVAGTMQEEEYQSIVEKACPGAGACGGMYTANTMASSIEALGMTLPYNSSNPALSPEKKQESIKAGEALRVLLEKDIKPSDIITRKSLENAIRLITILGGSTNAVLHFLAIARAAEIDFTLTDFQTISDNTPFLADLKPSGKYLMEDLHEVGGIPAVLKYLLKKGLIYGDCLTVTGKTLAENLRDVEDLKEGQEVIKPIESPIKISGHLRMLFGNLAEEGSVAKITGKEGLKFRGKAKVFEGEYKANDGIRDGKVQKGDVVVIRYEGPKGGPGMPEMLKPTAAIMGAGLGKDVALITDGRFSGGTHGFVVGHITPEAQEGGTIALVEEGDYITIDAETNSINLEVSDEELIKRKKNWKAPNLKFKRGVLYKYARMVNSASKGCVTDEF

SEQ ID NO: 211 - DNA, 1677 bp, Flavobacteriales bacterium
atggaattgaataaatacagtaaaaacgttacccaagaccccacacaaccagctgctcaagcaatgttgtatgccataggttttaaagatgaagattttaaaaaaccattagttggtatcgcaagtacgggatatgagggcaacccttgtaacatgcatttgaatgatttggccaaattggtcaaggacggcgtgaattcaaaggaaacggttggtttgattttcaatacaattggggtgagtgatggaatatccatgggaactcctggaatgcgtttttcattaccatcaagggatattattgccgattcaatggaaacggttgtccaaggaatgtcgtatgacgccttggtaacggtggtaggctgtgataaaaatatgccgggagcattaatggccatgttaagattgaataggccatcaatattggtatacggcggtacaattgcctctggatgtcataatgatagaaaattggatattgtttctgcttttgaagcttggggagaaaaagtggctggtaccatggaggagtctgagtataaaagtataataaggaaagcgattcctggggcaggtgcttgtggtggtatgtacacggcaaataccatggcttcagccattgaagctttgggaatgtcattgccttataattcttccaaccctgcagacaattatctcaaagagaatgaatgtattgaagcaggtaagcaaatgcgcgtacttattgagaaagatattaaaccactggacattgtaactcgtaagtcattggaaaatgcgattcgtttagttactatcatgggtggctcaacaaatgcagtattacatttcttggcaattgctagagccgcagatatagaatttacactacaagattttcaacatattagtgatacaacaccttttattgcagatttaaagccaagtggcaaatatttaatggaagatgtgcaccgtgtaggtggtataccggctgtattgaaatatttattgaaaaacggacttttacatggggattgtttaacggttactggcaagacattggctgaaaatcttgaaaatgtcccagatttagaagaggggcaagatgtaattatgcctttggacaaaccaataaaagcaaccggacatttacgcatgctttatgggaatctggcagaaaatggttcagttgcaaaaattacgggaaaagaaggtttggtgtttaaaggaactgccaaagtgtttaatagcgagtatgacgccaatgatggtattcgaactggattggtgaaaaagggtgatgttgttgtaattcgatatgaagggcctaaaggaggtcctggaatgccagaaatgttgaaaccaacagcagcaattatgggagctggtttaggaaaagaagtagccttgattacagatggtcgtttttcaggaggaacacacggttttgtagtaggacatatttcacccgaagctcaagaaggtggtacaattggtttggttaaaaatggtgacataattaccattgatgctgaaactaattcaatcaatgttgctgtttctgatgaagaattggcaaaacgaaagaccgaatgggtacaaccagaattaaaattcaaaaagggcgtgctttataaatatgcgcgttcggtttcatctgctgcggaaggttgcgtaacggatgagttttaa

SEQ ID NO: 212 - protein, 558 aa, Flavobacteriales bacterium
MELNKYSKNVTQDPTQPAAQAMLYAIGFKDEDFKKPLVGIASTGYEGNPCNMHLNDLAKLVKDGVNSKETVGLIFNTIGVSDGISMGTPGMRFSLPSRDIIADSMETVVQGMSYDALVTVVGCDKNMPGALMAMLRLNRPSILVYGGTIASGCHNDRKLDIVSAFEAWGEKVAGTMEESEYKSIIRKAIPGAGACGGMYTANTMASAIEALGMSLPYNSSNPADNYLKENECIEAGKQMRVLIEKDIKPLDIVTRKSLENAIRLVTIMGGSTNAVLHFLAIARAADIEFTLQDFQHISDTTPFIADLKPSGKYLMEDVHRVGGIPAVLKYLLKNGLLHGDCLTVTGKTLAENLENVPDLEEGQDVIMPLDKPIKATGHLRMLYGNLAENGSVAKITGKEGLVFKGTAKVFNSEYDANDGIRTGLVKKGDVVVIRYEGPKGGPGMPEMLKPTAAIMGAGLGKEVALITDGRFSGGTHGFVVGHISPEAQEGGTIGLVKNGDIITIDAETNSINVAVSDEELAKRKTEWVQPELKFKKGVLYKYARSVSSAAEGCVTDEF

SEQ ID NO: 213 - DNA, 1677 bp, unknown
  unidentified eubacterium SCB49
atggaattaaataaatatagtaaacgcgttactcaagacgattcacaacctgcagcaaaagctatgcttcatgctattggtttgagtaaagaagacttagataaaccatttgttggtattgcgagtacaggttatgaagggaatccttgtaatatgcatttaaacgatttagcgcttgaagtaaaaaaaggtacaaaaaataaagatttagtaggcctaatttacaataccattggtgtgagtgatggtatttctatgggaacacctggaatgagatattccctaccctctagagatgtaattgcagattcaatggaaacggtagtagaaggaatgtcttatgatgcacttgttacggtagtaggttgtgataaaaatatgcctggagctttaatggctatgttacgtactaaccgacctggcgttttagtttatggaggcaccattgcttctggatgtcataatggtaaaaaattagatgtcgtttctgcttttgaatcttgggggcaaaaagttgctggaaaaatagatgaaaaagaatatcaagatgtcattgaaaaggcatgtcctggtgcaggtgcttgtggtggtatgtataccgcaaacacaatggcatctgctatagaggcattaggaatggcattaccatataactcttctaaccctgctttaggaacagaaaaaaaagcagaatgcataaaagctggcgaagctgtccgtttactccttgaaaaagacattaaacctaaagatattgtcacaaaaaaagcattagaaaatgccatcaggttagtaacaataatgggaggatctacaaatgccgtgttacattttttagcgattgctagaaccactgatgttgaatttacattagaggatttccaaaaaatatctgataccactccttttttagcagatttaaaacctagtggtcagtacttaatggaagatgtccatgcggttggaggaacacctgctgttttaaaatacttattaaaaaatggcttattacatggagattgtctaactgtaacaggaaaaacattggctgaaaacctccaagatgtacccgatttattagaaaatcaaaaggttataaaatcaataaacaaccctattaaagagacagggcatttaagaatattaagaggaaatttatcaccagaaggtgctgttgcaaaaattacaggaaaagagggctttaaatttacaggtaccgcaaaagtttttgattctgaatatgacgccaatgatggcattagagatggtaaagtacaaaaaggcgatgttgtagttattagatatgaaggtcctaaaggtggtcccggaatgccagaaatgctaaagcctacagcagcaattataggagctggattaggtaatgatgtagctttaattacagatggaaggttttctggtggtacgcacggttttgtagttggtcatatttcgccagaagcacaagtaggcggtcctattgcttttgtacaaaacggagatgagataactatcgacgccattaaaaataccatagactttaatatttccgaagaagttttagaaaaacgtaaagcagcctggaaacaacccgatttaaagtataaaaaaggggttttatataaatatgccagaactgtatcatgtgcatctaaaggttgcgtaacagatgaattttaa

SEQ ID NO: 214 - protein, 558 aa, unknown
  unidentified eubacterium SCB49
MELNKYSKRVTQDDSQPAAKAMLHAIGLSKEDLDKPFVGIASTGYEGNPCNMHLNDLALEVKKGTKNKDLVGLIYNTIGVSDGISMGTPGMRYSLPSRDVIADSMETVVEGMSYDALVTVVGCDKNMPGALMAMLRTNRPGVLVYGGTIASGCHNGKKLDVVSAFESWGQKVAGKIDEKEYQDVIEKACPGAGACGGMYTANTMASAIEALGMALPYNSSNPALGTEKKAECIKAGEAVRLLLEKDIKPKDIVTKKALENAIRLVTIMGGSTNAVLHFLAIARTTDVEFTLEDFQKISDTTPFLADLKPSGQYLMEDVHAVGGTPAVLKYLLKNGLLHGDCLTVTGKTLAENLQDVPDLLENQKVIKSINNPIKETGHLRILRGNLSPEGAVAKITGKEGFKFTGTAKVFDSEYDANDGIRDGKVQKGDVVVIRYEGPKGGPGMPEMLKPTAAIIGAGLGNDVALITDGRFSGGTHGFVVGHISPEAQVGGPIAFVQNGDEITIDAIKNTIDFNISEEVLEKRKAAWKQPDLKYKKGVLYKYARTVSCASKGCVTDEF

SEQ ID NO: 215 - DNA, 1689 bp, Gramella forsetii
atggataaaacagcaatgaacaacaaatatagtagtacaataacacaaagtgattctcaacctgcctcacaggcgatgcttcacgctataggattaaataaagaagatctcaaaaaaccttttgtgggaattgggagtaccggttacgaagggaatccctgtaatatgcaccttaatgaccttgctaaagaggtgaaaaaaggaactcagaatgccgatttaaacggacttattttcaatacaataggcgttagtgatgggatttccatgggaacgccgggaatgcgattctcactgccttccagagatctaatcgcagattctatggaaactgttgtaggaggaatgtcttacgatggcctggttactgtagtgggttgcgataagaatatgcccggtgccttaatggctatgttgagactgaacaggccttctgtgctggtgtatggcggaacgatcgcttccggttgccataatggtaaaaaactggatgtggtgtctgcatttgaagcctggggctcaaaagtttcaggggatatgcaggaagaagaatatcagcaggtaattgaaaaagcctgtccgggggcaggagcctgtggagggatgtatactgcaaatacaatggcctcctctatcgaagctttagggatgagtctgccgttcaacagttccaatcctgcaaccggacctgagaaaactcaggaaagtgtaaaagcaggggaggcgatgaaatatttgctggagaatgatctaaaaccaaaagatatagtgaccgcaaaatcactggagaatgcaattcgactattaacggtgcttggtggttctaccaatgccgtacttcattttcttgcgatagcaaaagctgcagagatcaattttggattaaaagattttacaagaatatgtgaggaaacgcctttcctggcagatttgaagcctagcgggaaatacctgatggaagatattcacaggattggaggaatcccggctgtgatgaaatatatgcttgaaaaaggactgcttcatggcgaatgtatgacagttaccggaaaaacgattgccgaaaatcttgaaaatgtaaagccattacctgacgatcaggatgtaattcaccctgtcgaaaaacctatcaaagctaccggacacatcagaattttatacggaaatctggcttctgaaggctccgttgccaaaataacgggaaaagaaggattggaatttcaaggaaaagcaagagtgtttaatggtgaatttgaagctaacgaagggatttcttcgggcaaggttcaaaaaggggatgtggtcgtcattcgctatgagggtcctaaaggaggacctggaatgccagaaatgctgaaaccaacttcggccattatgggcgccggactagggaaaagtgtagcccttatcaccgacggaaggttctcgggaggaactcatggctttgtggtgggacacattactcctgaggctcagcaaggcggactcattggtctgttgaaggatggtgacgagataagtattaatgccgagaaaaatactattgaggcacatctttcagcagaagaaataaatagaagaaaagaagcctggaaagctcccgctttaaaggtgaacggaggagtactctataaatacgcaaaaacggtagcatcagcttcagaaggctgcgtaacagatgaattttaa

SEQ ID NO: 216 - protein, 562 aa, Gramella forsetii
MDKTAMNNKYSSTITQSDSQPASQAMLHAIGLNKEDLKKPFVGIGSTGYEGNPCNMHLNDLAKEVKKGTQNADLNGLIFNTIGVSDGISMGTPGMRFSLPSRDLIADSMETVVGGMSYDGLVTVVGCDKNMPGALMAMLRLNRPSVLVYGGTIASGCHNGKKLDVVSAFEAWGSKVSGDMQEEEYQQVIEKACPGAGACGGMYTANTMASSIEALGMSLPFNSSNPATGPEKTQESVKAGEAMKYLLENDLKPKDIVTAKSLENAIRLLTVLGGSTNAVLHFLAIAKAAEINFGLKDFTRICEETPFLADLKPSGKYLMEDIHRIGGIPAVMKYMLEKGLLHGECMTVTGKTIAENLENVKPLPDDQDVIHPVEKPIKATGHIRILYGNLASEGSVAKITGKEGLEFQGKARVFNGEFEANEGISSGKVQKGDVVVIRYEGPKGGPGMPEMLKPTSAIMGAGLGKSVALITDGRFSGGTHGFVVGHITPEAQQGGLIGLLKDGDEISINAEKNTIEAHLSAEEINRRKEAWKAPALKVNGGVLYKYAKTVASASEGCVTDEF

SEQ ID NO: 217 - DNA, 1677 bp, Robiginitalea biformata
atgaacctgaacaaatacagtaaaaacgtcacacaggaccccacccaaccggcagcgcaggccatgctttatgccattggcctgaccgaggaggaccttgaaaaacccctgatcgggattgccagcaccgggtatgaaggcaacccgtgcaacatgcacctgaacgatctggcgctgcacgtgaaggaaggcgtgaaccgctccgatctggtagggctgattttcaatacgatcggggtgagtgacgggatatccatgggaacctacgggatgcgttattccctcccttcccgggatattattgccgattccatggagaccgtggtccaggcgatgaactacgacggcctggtaactgtagtgggctgtgacaagaacatgcccggggcgctgatggcgatgatccgcctgaaccgcccctccgtaatggtttacgggggaaccattgcatccggttgcctgaacaaccggaaactcgatgtggtatcggcttttgaggcctggggccagaaagtggccgggaatatgcaggaggaggaatacaaacaagtaatccagaacgcctgcccgggagctggtgcctgtggcgggatgtatacggccaacacgatggcatcggctatcgaagccctggggatggccctgccttacaactcttcgaacccagccaccggttcggaaaagcaggaagattgcacccgcgccggccaggcggtgcgcaccttgctcgaaaaagatatcaagccgctcgacattattacaaaaaagtccctggagaatgccatccgcctcgtagtggtgatgggggggtccacgaatgccgtcctgcacttcctggccattgccaaggcagcgcgcgtaccgtttaccctggacgatttccagcggatcagtgacgaaacgccctttttggcagacctgaagcccagcggcaaatacctgatggaagatgtccaccgggtgggcggcgtgcctgccgtccttaaattcctgctcgctgaaggcatgctccacggggattgcctgacagttactggaaaaacccttgccgagaacctaaaggatgtcccggatctggaagccggtcaggaggttatccggcccctttccgacccgatcaagaaaaccgggcacctgcgtatcctgtacgggaacctcgcacccacaggttcggttgccaaaatcaccgggaaggagggactccggttccagggacccgcccgcgtatttgaggacgaatttgaagcaaaccggggcataggcgaaggcaaagtttcccggggggatgtggtagtcatccgctacgaaggtccccagggtgggcctggtatgcccgaaatgctcaagcccaccagtgccatcatgggggccggcctgggcaaggatgtggccctgatcaccgatggccgcttttcgggtggtacccacggatttgtagtggggcatgtaacacccgaagcacaggccggaggcccgattgccctgctccgggacggggacatcatcaccatcgacgccgaagccaatacgctttcggtagacctgagcgacgaggagctcaaccggcggcgggcagcctggaaggcccctgaactaaaggtgaagcggggcagcctgtacaaatatgccaaaacggtttcatcggcctctgaaggctgtgttaccgatgaaatttga

SEQ ID NO: 218 - protein, 558 aa, Robiginitalea biformata
MNLNKYSKNVTQDPTQPAAQAMLYAIGLTEEDLEKPLIGIASTGYEGNPCNMHLNDLALHVKEGVNRSDLVGLIFNTIGVSDGISMGTYGMRYSLPSRDIIADSMETVVQAMNYDGLVTVVGCDKNMPGALMAMIRLNRPSVMVYGGTIASGCLNNRKLDVVSAFEAWGQKVAGNMQEEEYKQVIQNACPGAGACGGMYTANTMASAIEALGMALPYNSSNPATGSEKQEDCTRAGQAVRTLLEKDIKPLDIITKKSLENAIRLVVVMGGSTNAVLHFLAIAKAARVPFTLDDFQRISDETPFLADLKPSGKYLMEDVHRVGGVPAVLKFLLAEGMLHGDCLTVTGKTLAENLKDVPDLEAGQEVIRPLSDPIKKTGHLRILYGNLAPTGSVAKITGKEGLRFQGPARVFEDEFEANRGIGEGKVSRGDVVVIRYEGPQGGPGMPEMLKPTSAIMGAGLGKDVALITDGRFSGGTHGFVVGHVTPEAQAGGPIALLRDGDIITIDAEANTLSVDLSDEELNRRRAAWKAPELKVKRGSLYKYAKTVSSASEGCVTDEI

SEQ ID NO: 219 - DNA, 1677 bp, Tenacibaculum sp.
atggaattaaataaacatagcaaaagattaacccaagacgaatctcaaccagcttctcaagccatgttgtatgcagtaggtttatcagaagaagatatgagcaaagcccaagttggtattgcaagtacaggttatgatggtaatccatgtaatatgcatctaaacaatttagctgcagaagttaaagtagaaagtaaaattgctggtttagttgggttaggttttaatactattggagtttcagacggaatttctatgggaacttctggtatgaattattctttagcttccagagatataattgcagattcaatagaaactgtaatgaatgctcaaagttatgatgccttagtttctgtggtaggttgtgacaaaaatatgccaggagctgtaattgcaatgttacgtttaaataggccatcaattatgatgtatggaggtacaattgcctctggtagttataaaggtaaaaaattaaatattgtatctgcctttgaagctttaggtcaaaaagtagctggagaaatagatgagaatgaatacaaagaaattataaaaagagccattccaggagcaggtgcttgtggaggtatgtatactgcaaatacaatggcttctgcaatagaatgtatgggttttgctttgccttataattcttctattccagcagaaaatccaaataaactatctgaagcagaaagaacagctttagctattaaaaacttattagagttagatttaaaacctttagatatcatttctaaaaagtcgttagaaaatgctgttgctttagtaaatgctttgggtggatctacaaatgcagttttacactttttagctatagcacatgcagcagaaatagattttactttagaagattttcaaaaagtatcagatagaacgcctttaattgcagatttgaaaccatcaggaaaatatttaatggaagatgttcatggagttggaggtacgcctgcaattatgaaatatttattggataatgggtatttgcatggagattgcttaactgttacaggtaaaactttagcagaaaacttggcagatgttaaagcaatggagtttgaagctcaagatgttatttatccaaaagataaagctttaaaaacgtcaggaaacattcaaatcatttatggaaatctagcaacagaaggtgcagtagctaaaatttctggaaacgaaggcttgttgtttgaaggtaaagctgtggtttacgatggtgagcaagcagcaaatacaggtatttctaatggtgaagtagaaaaaggtgatgtagttgttattagatatgtggggccaaaaggtgggccaggaatgccagaaatgttaaagccaacttctttaattatgggagcaggtttaggtaaatctgtagctttaataacagatggacgtttttctggaggtacacatggttttgttgtggggcatattacaccagaagcacaatcaggaggagctattgggcttttagaaacaggtgataaaattagaattagtgcagaagacaactcaataaatgtgcttatttctgatgaagagttagagaaaagaagagcaaattgggtggctcctgctttaaaacataaaaaaggaattttatacaagtacgcaaaatctgtagcctctgcatctaaaggatgtgttactgatttataa

SEQ ID NO: 220 - protein, 558 aa, Tenacibaculum sp.
MELNKHSKRLTQDESQPASQAMLYAVGLSEEDMSKAQVGIASTGYDGNPCNMHLNNLAAEVKVESKIAGLVGLGFNTIGVSDGISMGTSGMNYSLASRDIIADSIETVMNAQSYDALVSVVGCDKNMPGAVIAMLRLNRPSIMMYGGTIASGSYKGKKLNIVSAFEALGQKVAGEIDENEYKEIIKRAIPGAGACGGMYTANTMASAIECMGFALPYNSSIPAENPNKLSEAERTALAIKNLLELDLKPLDIISKKSLENAVALVNALGGSTNAVLHFLAIAHAAEIDFTLEDFQKVSDRTPLIADLKPSGKYLMEDVHGVGGTPAIMKYLLDNGYLHGDCLTVTGKTLAENLADVKAMEFEAQDVIYPKDKALKTSGNIQIIYGNLATEGAVAKISGNEGLLFEGKAVVYDGEQAANTGISNGEVEKGDVVVIRYVGPKGGPGMPEMLKPTSLIMGAGLGKSVALITDGRFSGGTHGFVVGHITPEAQSGGAIGLLETGDKIRISAEDNSINVLISDEELEKRRANWVAPALKHKKGILYKYAKSVASASKGCVTDL

SEQ ID NO: 221 - DNA, 1677 bp, Polaribacter irgensii
atggaattaaacaaacatagcaaaagattaacacaagatgaatctcaaccggcatcacaagcaatgttgtacgctgtaggtttaacagatgaggacatgcagaaggcgcaaattggtattgcaagtactggatatgacggaaatccttgtaatatgcatttaaatcatctaaaagaagaggttaaagtagagtgtaatattgcgggtttagtcggtttagggttcaatacaattggggtgtcagatggaatttctatgggaacttcaggcatgaattattctttagtttcaagagatatcatagcagactctatcgaaacggttatgaatgcacaaagttacgatgcagtaattgctattgtgggttgtgataaaaatatgccaggatcagtgattgccatgctgcgtttaaatcgccctgcgataatgatgtatggcggctcgactgcatcgggaaattacaaaggaaaaaagttaaatattgtttccgcttttgaggctttaggtcaaaagatgtctggagaaattgaagaagaagagtatcgagaaataattaagagggccattccaggcgctggagcgtgtggtggtatgtacactgcaaatacaatggcttctgcgattgaatgtatggggttctcattgccttataattcttcaattccggcagaaaatccgaataaattgtctgaagcggaaagaactgccttggcgattaaaaacttactagaattagatttaaaacctttagatattatttctaagaaatctttagaaaatgccattacccttgtaaatgcgttaggagggtcaacaaatgccgtcttgcatttcttagcaattgcgcacgctgcagatattgagtttactttagaggattttcaaagagtgagtgacagaacaccattaattgcagatttgaaaccatcaggaaaatatcttatggaagatgtgcataatattggaggcacacctgcgatcatgaaatatttattagaaaatgactatttgcacggggattgtttgacggttacaggaaaaacattggctgagaatttagcaaatgttaaggcgatggaatttgaagagcaagatgtgatttacccaaaagagaacgcattaaaatcatcaggaaatattcaaataatttatggaaacctagcaactgaaggagcagtagcaaaaatatctggaaacgaagggctactttttgaaggaaaagctgtcgtgtatgatggtgagcaagctgcaaatacagggattacaaatggagaggtagaaagaggagatgtcgtcgttattagatacgtgggtcctcgaggaggtccaggaatgccagaaatgctgaaacctacgtccttaattatgggtgcaggtttaggaaagtctgtagcattaattacagatggaagattttctggaggaacacatggctttgttgttggacacattacaccagaagcacaatcgggaggaaccattgggattttaaaaactggcgatacaattagaattagtgcagaagataattctattaatgttttaatttctgaggatgaaattgcagcaagaaaagtaaaatgggttgcacccgcactaaagcatacaaaaggaattttgtataaatatgcaaaaacagtagcatccgcatctaaaggatgtgtaacagacttataa

SEQ ID NO: 222 - protein, 558 aa, Polaribacter irgensii
MELNKHSKRLTQDESQPASQAMLYAVGLTDEDMQKAQIGIASTGYDGNPCNMHLNHLKEEVKVECNIAGLVGLGFNTIGVSDGISMGTSGMNYSLVSRDIIADSIETVMNAQSYDAVIAIVGCDKNMPGSVIAMLRLNRPAIMMYGGSTASGNYKGKKLNIVSAFEALGQKMSGEIEEEEYREIIKRAIPGAGACGGMYTANTMASAIECMGFSLPYNSSIPAENPNKLSEAERTALAIKNLLELDLKPLDIISKKSLENAITLVNALGGSTNAVLHFLAIAHAADIEFTLEDFQRVSDRTPLIADLKPSGKYLMEDVHNIGGTPAIMKYLLENDYLHGDCLTVTGKTLAENLANVKAMEFEEQDVIYPKENALKSSGNIQIIYGNLATEGAVAKISGNEGLLFEGKAVVYDGEQAANTGITNGEVERGDVVVIRYVGPRGGPGMPEMLKPTSLIMGAGLGKSVALITDGRFSGGTHGFVVGHITPEAQSGGTIGILKTGDTIRISAEDNSINVLISEDEIAARKVKWVAPALKHTKGILYKYAKTVASASKGCVTDL

SEQ ID NO: 223 - DNA, 1698 bp, Pedobacter sp.
atgtcaacaacaccagaattaaaccgctatagcaaaacattcactcaagatcctacacaacctgccgcacaggccatgttgtatgggattggcctaacaaaagaggacctcgacaaagcccaggtaggcattgccagcatgggttacgatggaaacacctgtaacatgcacctgaacgacctcgctcaggtggtaaaaaaaggcgtctgggacaacggaatggttggcctgaccttcagcaccatcggtgtgagtgatggaatgtctaatggtacagacggaatgcgttactccctggtatccagagatgtcatcgccgattctattgagaccatctgtggcggacagtattatgatggtgtcatcaccattcctggatgtgacaaaaatatgccgggatccatcattgccatgggacgtctgaaccgcccctcgatcatggtatatggtggaagtatccactccggaaactataaaggcaaagccctgaacattgtttctgcttttgaagcattgggtcagaaacttgccggtaacatcgaagaagaagattatcaaggcatcatccgccatacctgccctggtgcgggtgcatgtggggggatgtataccgcaaatactatggcctctgcaattgaagcaatgggcatgagtttgccttatagctcctcctaccctgctaccagtcaggagaaaaaggatgaatgtatcaatgctgccaaagcaatccgtgttttgctggagagaaacattcttccaagtgacatcatgaccgagaagtcattccacaacgccatcgtaacggtgatggtactaggtggatctaccaatgccgtactccacctgattgcaatggccaaatctgtaggcctgaacctgaagatcgatgatttccaggacgtaagtaacaatactccggtacttgccgatttaaaacctagtggtacttacctgatggaagacctgcatgaaattggtggtgttcctgcagtattaaaatatctattgaaagaaggactgttgcatggcgactgtatgacggtaacgggtaaaacccttgctgagaatgtggctgatgccgtagacctggatttcgatcagcaaaagatcatcttcccggtcagcaacccgctaaaaacaactggtcacctgcagatcctgtatggcaacattgctcaaaaaggatcagtagcaaaaatcagtggtaaagaaggcgagaaatttgaaggccctgcacgtgtatttgacggggaaaaatcgttgatcgcaggaatcctgagtggacgtgtacgccagggtgatgtggtcgtgatcagacaggtaggccctaaaggagctcctggaatgcctgaaatgctgaaaccgacatctgccatcattggcgccggactgggtaaatcggttgccctgatcactgacggaaggttctccggaggtacacatggtttcgtagtgggacacatcactcctgaagcatgggatggtggaaacatcgcctttgttaatgatgatgacatgattaccattgatgcagtcaacaataccattaacctgaagatctctgatgaggaaatggctaaacgtaaggcagaatggaaacagttgcctccgccagtgaaaagcggtgtattgtacaaatacatcaagcaggttagtgatgccagcgaaggatgtgttactgacgcctacacacattaa

SEQ ID NO: 224 - protein, 565 aa, Pedobacter sp.
MSTTPELNRYSKTFTQDPTQPAAQAMLYGIGLTKEDLDKAQVGIASMGYDGNTCNMHLNDLAQVVKKGVWDNGMVGLTFSTIGVSDGMSNGTDGMRYSLVSRDVIADSIETICGGQYYDGVITIPGCDKNMPGSIIAMGRLNRPSIMVYGGSIHSGNYKGKALNIVSAFEALGQKLAGNIEEEDYQGIIRHTCPGAGACGGMYTANTMASAIEAMGMSLPYSSSYPATSQEKKDECINAAKAIRVLLERNILPSDIMTEKSFHNAIVTVMVLGGSTNAVLHLIAMAKSVGLNLKIDDFQDVSNNTPVLADLKPSGTYLMEDLHEIGGVPAVLKYLLKEGLLHGDCMTVTGKTLAENVADAVDLDFDQQKIIFPVSNPLKTTGHLQILYGNIAQKGSVAKISGKEGEKFEGPARVFDGEKSLIAGILSGRVRQGDVVVIRQVGPKGAPGMPEMLKPTSAIIGAGLGKSVALITDGRFSGGTHGFVVGHITPEAWDGGNIAFVNDDDMITIDAVNNTINLKISDEEMAKRKAEWKQLPPPVKSGVLYKYIKQVSDASEGCVTDAYTH

SEQ ID NO: 225 - DNA, 1680 bp, Flavobacteria bacterium
atggaattaaataaatatagtaaaacaataacacaagatccttctcaacctgcttctcaagcaatgttatatggaattggtttaactgaagaacaactagcaaaaccttttataggaattgcttcaatgggttatgatggaaatacttgtaatatgcatttaaatcatttagcagctttaattaaaaaagaagttaatgctaatgatatggtgggtttaattttcaacacaattggtattagtgacggtattactaacggaactgatggaatgcgttattctctagtaagtagagaaattattgcagatagtattgaaagtgttgtttcaggtcattactatgatggtgtaatttctattcctggttgtgataaaaatatgccaggaagtattattgcaatgggaagattaaatcgtccatcgataatggtttatggtggtacaattgcaccaggaaaataccaaggtaaagatttgaatattgtttcggcatttgaagcattaggagaaaaaattgcgggtactatttctgaagaagactataaaggaattataaagaattcatgtccaggtgcaggagcttgtggcggcatgtatacggcaaatacaatggctattgctattgaagcattaggaatgagcttaccttattcaagttcaaatcctgctataagtcatgataaaatagaagaatgtgaatctgccgctggatatttaaaattattattagaaaaaaatatttgtccaaaagacattatgacgtttgaagcatttgaaaatgctattaccgttttaattgctctaggaggaagtacaaatgccgttttgcatatgattgcaatggcaaaaagtgttggagtagctataagtcaggataattttcaacgattaagcaatacaactccattaattgccgattttaaaccgggtggaaattatttaatgcaaaacctacatgaaaaaggtggtgtgccaatggttttaaaatatttgctttctaaaggaatgttacatggaaattgtattacggtaacaggtaaaactttagcagaaaatttagaagcagtaatagatattgattttaacgatcaaaatattattcgtcagatagagaatccaataaaaactacagggcatcttcaaattttatatggaaatcttgctttaaaaggttccgtagcaaaaataacaggtaaagaaggcgaattttttaaaggtccagctcgtgtttttgatggtgaaaaagaattaataaaaggtatcgaagataaaaaaataaaagctggcgatgtcgtagttatacgatatgtaggtccgaaggggggacctggaatgcccgaaatgctaaagccaacatcagccttaattggtgctggtttaggaaaaagtgttgcattaattaccgatggtcgttttagtggaggaactcatggttttgtagtaggtcatatttcacctgaagcttatgatggaggtacaattgctttagttgaagatgaagatattatagaaattaatgctgttgataataccattcatttacatgttggtgatgaagaattagcgaatagaaaaagtaaatggaatcaaccaaaattaaaagtaactaatggtgtgttattaaagtatgcaaaattagttacagatgcttcaaatggttgtgtaaccgatgaatattag

SEQ ID NO: 226 - protein, 559 aa, Flavobacteria bacterium
MELNKYSKTITQDPSQPASQAMLYGIGLTEEQLAKPFIGIASMGYDGNTCNMHLNHLAALIKKEVNANDMVGLIFNTIGISDGITNGTDGMRYSLVSREIIADSIESVVSGHYYDGVISIPGCDKNMPGSIIAMGRLNRPSIMVYGGTIAPGKYQGKDLNIVSAFEALGEKIAGTISEEDYKGIIKNSCPGAGACGGMYTANTMAIAIEALGMSLPYSSSNPAISHDKIEECESAAGYLKLLLEKNICPKDIMTFEAFENAITVLIALGGSTNAVLHMIAMAKSVGVAISQDNFQRLSNTTPLIADFKPGGNYLMQNLHEKGGVPMVLKYLLSKGMLHGNCITVTGKTLAENLEAVIDIDFNDQNIIRQIENPIKTTGHLQILYGNLALKGSVAKITGKEGEFFKGPARVFDGEKELIKGIEDKKIKAGDVVVIRYVGPKGGPGMPEMLKPTSALIGAGLGKSVALITDGRFSGGTHGFVVGHISPEAYDGGTIALVEDEDIIEINAVDNTIHLHVGDEELANRKSKWNQPKLKVTNGVLLKYAKLVTDASNGCVTDEY

SEQ ID NO: 227 - DNA, 1677 bp, Flavobacterium psychrophilum
atgaacacaataaacaaatacagtaaaaccataacgcaagacgaaacccaaccagcagcacaagccatgctttatggaatagggttaacggaagcagatatgtataaagcacaagtaggaattgtaagtacaggttatgaaggtaatacttgcaatatgcacttgaacgatttagccaaagacgtaaaatttggagttgcatctgaaaatttagtcggattaatatttaatactataggcgtaagcgatggtatctctaacggtacagatggtatgcgattttcattggtatctcgagacataattgcagactctatagaaacagtggttagtgcacaatggtacgatgccgttttagccgtagtgggatgtgataaaaatatgcctggatctgtcatggctatgggaagactaaatcgacctgctataatgatatatggtggtagtattcattctggaaaatggaaaggagaatccttaaatattgtgtcggcttttgaagctttgggaaaaaaatttaacaatacaataaccccagaagattttaaaggtgttataaaaaacgcttgtccaggtgcaggtgcttgtggcggaatgtacaccgcaaacaccatggcttccgcaattgaagctttgggaatgagcttaccatatagttcgtctaatccagctttgagccaagaaaagaaacaagaatgtttagatgcaggcaaagcaatccgagttttattagaaaaagacatcaaacctaaagacatcatgaccaaaaaagccttcgaaaatgcaatgacgatggtggtggttcttggtgggtctacaaatgccgttttgcatttaatagccatggcacattcagtagatatagaattaaccctgcaagacttccaaaaaacaagtaacaacattcctgttttagcagatttaaaaccaagcggaaaatacctcatggaagatttacacgcagtgggaggggttcctgcggttatgaaatatttgctagaaaacaagctgttacacggtgattgcttaacagtaacagggaaaacagtagccgaaaatttagcaaatatccctagtttacatcaaggacaaactgtttttcttcctctaaaaacgccactaaaagccacaggacatttgcaaatcctttacggaaacctagcgccagaagggagtgttgcaaaaataagcggcaacgaaggtgatttctttgaagggaaagccaaagtttataatgatgaatataccgtgattgatggcgtaaaaaacggagaggttgcctctggagatgtagttgtaattagatattgcggaccaaaaggaggaccgggaatgccagaaatgctaaaacctacttccgcaataatgggagctggtttaggaaaaaatgtagcattaataaccgacggaagattctcggggggaactcatggttttgtagtggggcatattacacctgaagcttacgacggaggaaccattgcgctagtaaaagatggtgatacaattaccattaatactaaaaataacaccattcaattaaaagttagcgaagaagaattaaccaaaagaaaatccgaatggaaacaacctaaacttaaagctaccaaaggtgttttgtataaatatgcccaatgtgtttcaagtgcatctaaaggttgtgtaaccgataattaa

SEQ ID NO: 228 - protein, 558 aa, Flavobacterium psychrophilum
MNTINKYSKTITQDETQPAAQAMLYGIGLTEADMYKAQVGIVSTGYEGNTCNMHLNDLAKDVKFGVASENLVGLIFNTIGVSDGISNGTDGMRFSLVSRDIIADSIETVVSAQWYDAVLAVVGCDKNMPGSVMAMGRLNRPAIMIYGGSIHSGKWKGESLNIVSAFEALGKKFNNTITPEDFKGVIKNACPGAGACGGMYTANTMASAIEALGMSLPYSSSNPALSQEKKQECLDAGKAIRVLLEKDIKPKDIMTKKAFENAMTMVVVLGGSTNAVLHLIAMAHSVDIELTLQDFQKTSNNIPVLADLKPSGKYLMEDLHAVGGVPAVMKYLLENKLLHGDCLTVTGKTVAENLANIPSLHQGQTVFLPLKTPLKATGHLQILYGNLAPEGSVAKISGNEGDFFEGKAKVYNDEYTVIDGVKNGEVASGDVVVIRYCGPKGGPGMPEMLKPTSAIMGAGLGKNVALITDGRFSGGTHGFVVGHITPEAYDGGTIALVKDGDTITINTKNNTIQLKVSEEELTKRKSEWKQPKLKATKGVLYKYAQCVSSASKGCVTDN

SEQ ID NO: 229 - DNA, 1674 bp, Flavobacterium johnsoniae
atggaattaaataagtacagcaaaaccatcactcaagatcaaacacagcctgcggcgcaagcaatgttgtatggaattggtttaactgaagaagatttaaaaaaagcacaagttggtattgtcagcatgggttatgatggtaatacttgcaatatgcacttaaatgatttagcaaaagatgttaaaaaaggtgtttgggatgctggtctggtcggacttatttttaataccattggtgtaagtgacggaatttctaacggtacagaaggaatgcgttattcattagtttctcgtgatgtaatcgcagattctattgaaactgtagccggtgcacaatggtacgatagtattattgcaattcctggctgcgataaaaatatgcctggagcattaatcgcaatgggaagattaaaccgtccgtcaatgatggtttatggaggatctatccactcaggaaaatggaaaggtgaatctctaaacatcgtttctgcttttgaagctttaggaaaaaaagtaaaaggcgaaattactccggaagattttaaaggtgttattcaaaatgcttgtcctggagctggtgcctgcggtggtatgtatactgcaaacactatgtcttctgcaattgaagcattaggtatgagtatgccttacagttcttctaaccctgctttgagtcaggaaaaaagagacgaatgtattgctgccggagaagctattaaagttttattagaaaaagatattaagccaagagatattatgactcgtaaagctttcgaaaatgctattacaattgtagcagttttaggaggttctacaaacgcagttatgcacttaattgcaatggcacactctgttggtattacaattactcttgatgattttcaggcaattaacgacagaacacctgttcttgccgatatgaaaccaagtggtaaatatatgatggaagacattcacgaagtgggaggtattccgggtgtaatgaaatatttattgaaagtgggacttatccacggagattgtttaacagtaactggaaaaacagttgctgaaaacttagcttctacaccggatttacaagacggacaagaagtaattcatgaaattcaaaaagcgttaaaaccaacaggaaatattcaggttttatacggaaaccttgcttctgaaggagctgtggcaaaaatcagcggaaaagaaggggaatatttcgaaggaccagctgttgtatttgaaggggaatttgaagtaattccaggcttgcaggccggaaagattaaaccaggtaatgtcgtcgtcattagaggttgtggaccaaaaggtggtccgggaatgcctgaaatgctaaaaccgacatctgccattattggtgcaggattaggaagcagctgtgcacttattacagacggcagattctccggaggttcacacggattcgtggtaggacacgtaacaccagaggcttatgatggaggtggtattgcactagtaaaagatggagatttaattgctatcgatgctgtaaaaaatacaatcgacctgaaaatatctgacgaagaatttgcagctcgtaaagcggcttgggttcaaccagcgctaaaagttgacagaggggttttacttaaatacgcaagatcggtttctagtgcttcaacaggctgtgttaccgataattaa

SEQ ID NO: 230 - protein, 557 aa, Flavobacterium johnsoniae
MELNKYSKTITQDQTQPAAQAMLYGIGLTEEDLKKAQVGIVSMGYDGNTCNMHLNDLAKDVKKGVWDAGLVGLIFNTIGVSDGISNGTEGMRYSLVSRDVIADSIETVAGAQWYDSIIAIPGCDKNMPGALIAMGRLNRPSMMVYGGSIHSGKWKGESLNIVSAFEALGKKVKGEITPEDFKGVIQNACPGAGACGGMYTANTMSSAIEALGMSMPYSSSNPALSQEKRDECIAAGEAIKVLLEKDIKPRDIMTRKAFENAITIVAVLGGSTNAVMHLIAMAHSVGITITLDDFQAINDRTPVLADMKPSGKYMMEDIHEVGGIPGVMKYLLKVGLIHGDCLTVTGKTVAENLASTPDLQDGQEVIHEIQKALKPTGNIQVLYGNLASEGAVAKISGKEGEYFEGPAVVFEGEFEVIPGLQAGKIKPGNVVVIRGCGPKGGPGMPEMLKPTSAIIGAGLGSSCALITDGRFSGGSHGFVVGHVTPEAYDGGGIALVKDGDLIAIDAVKNTIDLKISDEEFAARKAAWVQPALKVDRGVLLKYARSVSSASTGCVTDN

SEQ ID NO: 231 - DNA, 1713 bp, Lactococcus lactis
atggaattcaaatataacggaaaagttgaatcaatagagctcaataagtattcaaaaacattgacacaagacccaacacagccagcgacccaagccatgcactatggcattggttttaaagatgaggacttcaaaaaagctcaggtcggaatcgtcagcatggattgggacggaaatccctgtaacatgcacttgggcacactcggtagtaaaatcaaaaattctgtcaatcaaactgacggactgattgggcttcaatttcacacgattggggtttctgacggaattgccaacggaaagcttggcatgagatattccttggtcagtcgtgaagttattgctgacagtattgaaaccaacgctggcgccgaatattacgatgcaattgtcgctgttcccggttgtgacaaaaatatgccaggctcaatcattggcatggctcggctcaatcgtccgtcaattatggtttatggtggaacgattgaacatggcgaatacaaaggcgaaaagttaaatattgtttcggcttttgaagcgcttggacaaaaaatcactggaaatatttccgaggaagattatcacggcgtcatttgtaatgccattccgggacagggtgcttgtgggggcatgtatacagcaaatacactggcttcggcaattgaaactttgggaatgagtttgccttattcggcttcaaatccagcggtcagtcaagaaaaagaagacgaatgtgatgaaattggtctggcaatcaaaaatttgctagaaaaagacatcaaaccaagcgatatcatgaccaaggaagcttttgaaaatgccataacgatcgtcatggttctcggtggttcaactaatgctgtgcttcatatcattgccatggctaatgccatcggtgtcgaaattacgcaagatgattttcaacgtatttccgatgtcacgcctgtgcttggcgacttcaagccaagtggcaagtacatgatggaagatttgcacaaaattggtggcgtgcctgctgttttgaaatatttgctcaaagagggcaagcttcatggcgactgtttgacagttactggtaaaactctagctgaaaatgttgaaacagcactggatttggactttgacagccaagacattattcgaccacttgaaaatcctatcaaagcaacaggtcatttgcaaattctctatggcaatcttgctgaaggtggttctgtggcaaaaatttctggaaaagaaggggaatttttcaaaggaacagctcgtgtctttgatggcgaacaacattttattgacggaattgagtcaggtcgtttgcacgcaggagatgtcgctgtcattcgtaatatcggtccagtcggaggcccaggaatgccagaaatgttaaaaccgacctcagccttgattggagcaggtcttggaaaatcttgtgctttgattactgacggacgtttctctggtggcacacatggctttgtggttggccacattgtccccgaagcggttgagggtggattgattggcttggtcgaagatgatgatattatcgagattgatgcggtcaataacagcattagtttgaaagttgctgacgatgagattgctagacgacgtgccaattatcaaaaacctgctcctaaagcaacgcgtggggttcttgctaaatttgctaaactcacgcgcccagccagtgaaggctgtgtgactgatttatag

SEQ ID NO: 232 - protein, 570 aa, Lactococcus lactis
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 233 - DNA, 1686 bp, Psychromonas ingrahamii
atgtcagaaataaataagtattcaaaaacagtgacgttagatgaatcacaaccggcttcacaggccatgctttatgctattggtttgaaagaagaggatatgaaaaaagcgcaagtgggtattgtttcaacaggatgggaaggaaatccatgcaatatgcacttaaacgaatttgctaaagacgtgaaaaaaagtgtgaacgcagctgatttggtgggattaatctttcacacaatcggagtgagtgatggtatttcaaacgggactaccgggatgaagtactctttagtgtctcgtgagatcattgctgattctattgaaacggttgtaagtgcgcaattttatgatgcgattgttgccattgtaggatgtgataaaaatatgcccggtgcaatgatggcattgtcgcgtttaaatcgtccgggaatattggtttatggcggttcggttaaagctggaaaatggaaaggtgaagacttgaatatcgtttctgctttcgaagcttatggaaaaaaattacagggtgttatctcccatgaagattataaaggggtaattcaaaatgcgatcccgggtccgggtgcttgtggtggaatgtatacggcaaatactatgtcttcagctattgaagcgttaggcatgagtttgccttactcttcatcgaacccggcggttagcgatgacaaaaaaagagaattaacaacagtgggtgatgcagttaaaaacctgctggaaaaagatattaaaccaaaagatattatgaccaaaaaagcgttcgagaatgccttaagaattattatgattttagggggctctaccaatgcaactttacatatgattgcaatggcccgatcatcaggtgttgacttgagtttagatgatttccaaaagatggcagataaaacgccattattggcaaatttaaaaccttccggggaattcctaatgcaagacttacatgaaatcggcgggatccctgcagtcatgaaatacttattggctgaaggtttattacatggggattgtttgaccgttacaggtaacaccattgctgaaaacttagctgatttacccggccttcctgatgatcaggacattatcagacctttgtctaaccccttgaaagaaactggccacttacagattctttatggaaacttggcacctgaaggttcagttgcaaagattacaggtaaagaaggcgaagtattcgaaggcccggcaagagtttatgaagatgaattttcagcaataaaaggtatcggagacgaagtgcaaaaaggtgaagttatcgttatccgttattcaggaccaaaaggtgcgcctggcatgccagaaatgctaaaaccaacttcagctgtaatgggggcgggtcttggaaaagacgtggcattaattacagatggcagattctccggaggttctcatggttttgttgttggacacgtgacgccagaggcatcggaaggtggattgattgccctggtccaaaatggagacatgatccgaattgattctgttactaacaaattggaattgaaagtcgatcaggctgaaatcaacaagcgtaaagctgcttggataaaaccagcttacagagcgacaaatggtgtactaagaaagtatatcgccacggtaaaatctgcctctctaggatgtgttaccgatgaaatagacgaactgtag

SEQ ID NO: 234 - protein, 561 aa, Psychromonas ingrahamii
MSEINKYSKTVTLDESQPASQAMLYAIGLKEEDMKKAQVGIVSTGWEGNPCNMHLNEFAKDVKKSVNAADLVGLIFHTIGVSDGISNGTTGMKYSLVSREIIADSIETVVSAQFYDAIVAIVGCDKNMPGAMMALSRLNRPGILVYGGSVKAGKWKGEDLNIVSAFEAYGKKLQGVISHEDYKGVIQNAIPGPGACGGMYTANTMSSAIEALGMSLPYSSSNPAVSDDKKRELTTVGDAVKNLLEKDIKPKDIMTKKAFENALRIIMILGGSTNATLHMIAMARSSGVDLSLDDFQKMADKTPLLANLKPSGEFLMQDLHEIGGIPAVMKYLLAEGLLHGDCLTVTGNTIAENLADLPGLPDDQDIIRPLSNPLKETGHLQILYGNLAPEGSVAKITGKEGEVFEGPARVYEDEFSAIKGIGDEVQKGEVIVIRYSGPKGAPGMPEMLKPTSAVMGAGLGKDVALITDGRFSGGSHGFVVGHVTPEASEGGLIALVQNGDMIRIDSVTNKLELKVDQAEINKRKAAWIKPAYRATNGVLRKYIATVKSASLGCVTDEIDEL

SEQ ID NO: 235 - DNA, 1677 bp, Microscilla marina
atgacagttttgaacaaatacagccgacgaattactcaggatgtaacccaaccagcctctcaagcaatgctgtatggcatagggcttactaaagaggatatgagcaagcctcaaataggcatagtaagtactggttatgagggcaatacctgcaacatgcacctcaatgatctggccttggaaaccaaaaaaggtactaaagaagcagacttggtagggttggtattccatactataggcgtaagcgacggaatatctaacggtaccgaaggaatgcgtttttcgttgccttcacgcgacattatcgccgactcgatagagactgtagtgcaggctcaatggtacgatgggatacttgctgtagtgggttgcgacaaaaacatgccgggagctatgatggctctggcgcgtttgaaccgtcctggactgcttgtttacggcggaagcatcaggtcaggctgtcacaaaggtcaaaaactcaatattgtgtctgcctttgaagcactcggacagcgttttaacggaagtttgaatgaagaagattatcaaggaattatccaaaactcttgccctggtgcaggagcttgtggcggtatgtatactgccaacacgatggcaacagtgatagaagctattggattgggcttaccttatggagcctctaatcccgcccaaagccctgaaaaacaacaagaatgtatagatgcgggcaaagctatgagaaagctgctcgaagaggacatcaaacccctcgacatattgaccaaaaaagcttttgaaaatgccttgacaatgatcatggtcatgggaggctctaccaatgcggtgctgcacatgattgccattgccaaagctgctgaggtggatctaagcctggaagattttcaacgtatcagcgacaaaactccttatttggcaaatctcaagcctagtggaaagtacttgatggaagacttgcacaccattggtggcacccctgctgtaatgaagctattgctggacgagggattgctacacggtgattgtttgacggtaacgggcaaaacgcttgctgagaatcttgctaacattgctccggtaaaagacgatcaggacgtgctgttcccaataagccaacctctaaaacctcagggacatttacaagtgttatttggcaacctggccacacaaggggcagtagctaaaattacgggcaaagagggagaaaaatttgaaggtactgccaaggtgtacgacggagagtttgaggctatcaaaggtattcaggacggagaagtaaaagctgggcacgtggtagtcattaggtacgaaggccccaagggtggtccgggaatgcctgaaatgctcaagcctacctctgcaataatgggtgccgggctgggcaatagcgtggcattgattacagatggtaggttttcgggtggttcacacggttttgtagtgggacacgtgtgccctgaagcacaggaaggtggcttgattgccttgcttaaggatggcgatcgaatcacgattgatgcggtagacaaccaaatggtggcgcacttatcagaggaagaaatagcccaacgacgcgcccaatggcaagcaccagaatcgcgctttacccgtggaattttaggcaaatatgcccgtactgtttcgtcggcctcggagggctgtgtaacggatgaatag

SEQ ID NO: 236 - protein, 558 aa, Microscilla marina
MTVLNKYSRRITQDVTQPASQAMLYGIGLTKEDMSKPQIGIVSTGYEGNTCNMHLNDLALETKKGTKEADLVGLVFHTIGVSDGISNGTEGMRFSLPSRDIIADSIETVVQAQWYDGILAVVGCDKNMPGAMMALARLNRPGLLVYGGSIRSGCHKGQKLNIVSAFEALGQRFNGSLNEEDYQGIIQNSCPGAGACGGMYTANTMATVIEAIGLGLPYGASNPAQSPEKQQECIDAGKAMRKLLEEDIKPLDILTKKAFENALTMIMVMGGSTNAVLHMIAIAKAAEVDLSLEDFQRISDKTPYLANLKPSGKYLMEDLHTIGGTPAVMKLLLDEGLLHGDCLTVTGKTLAENLANIAPVKDDQDVLFPISQPLKPQGHLQVLFGNLATQGAVAKITGKEGEKFEGTAKVYDGEFEAIKGIQDGEVKAGHVVVIRYEGPKGGPGMPEMLKPTSAIMGAGLGNSVALITDGRFSGGSHGFVVGHVCPEAQEGGLIALLKDGDRITIDAVDNQMVAHLSEEEIAQRRAQWQAPESRFTRGILGKYARTVSSASEGCVTDE

SEQ ID NO: 237 - DNA, 1689 bp, Cytophaga hutchinsonii
ttgattattgtgagtacagaattaaataaaataagtaaacgtttaacccaggatccatctcagcccgcatctcaggcaatgatgtatggagctgggtttacagacgaggatatgaaaaagccaatcgttggtattggcagtacaggtttcgatggtaacacatgtaacatgcacttaaatatccttgccggacaagttaaaggcagtattacgcgtggcggtatggttggacttggtttcaacacgatcggcgtaagtgatgggatttcaatgggtacagaagggatgcgtttctctcttgtatcacgcgacgtaattgcggattcaattgaaacaatttgtgaagctcattactacgatgcgttggtaaccgttgtaggttgtgataaaaacatgcctggcgcacttattgcaatggctcgcttgaatcgcccgtcaatcatggtatacggcggtacaattcactcaggtcactacaaaggcgaaaaactaaacatcgtttcagcttttgaagcattgggtaaaaaagtagccggcacaatcactgaagaagattaccagggtgtaattaaaaatgcatgtccgggtgcgggtgcctgtggtggcatgtacacagcaaacacaatggcatctgcaattgaagcaatgggattaacacttccttattcttcaacggcacctgcaacaagcgaaaagaaaaaggcagaaacattggcgcttggcaaagcaatgatgcatctgctggagaaagatatcaagccgcgtgatatcatgacattcgaggcatttgaaaatgctatccgtgtgatcctggtattgggtggttctacaaatgcggtaatgcacttaattgcaattgcaaaagctgcgggtgttaaattaacgatcgatgattttcaacgcatcggtaatacaacaccgttactggcagatttaaaaccaagcggcaagtatatgatggaagatatggacgctattggcggcgtaccttctgtaatgcgtttgttggcaaaacataatttacttcatttagattgtatgactgtaacaggtaaaactgttggagagaatttaaaagaagctcaggatcttcctacggatcaggatctgatgtatgcatgggaaaacccgatcaaacaaacaggtcacttacagattctgtatggcaatcttgcaccacaaggttctgtggcaaagattaccggtaaagaaggaacatactttgaaggtcctgcacgcgtgtacgactctgaagaggctgtaaacaaaggtttagaggctaatgaagtaaaatcaggtgaagtaattgtaatccgttatgttggtccgaaaggcggcccgggcatgcctgaaatgttgaagccaactgctctattaatgggcttaggtttaggcaacgaatgtgccttaatcacagacggacgtttctctggcggtacacatggtttcgtagttggccacattacaccggaagcaacagaagggggtatgattggccttgtaaaaaatggcgacatcatccgtattgatgcagtaaacagagtcctagaagttaaaatttccgaggaggaagtaaccaaacgccgtgcggcatgggtaaaacctgcgccaagagctacatccggcgtgttatataaatacatgaaattagtatcttctgcatctgagggatgcgttaccgataattaa

SEQ ID NO: 238 - protein, 562 aa, Cytophaga hutchinsonii
MIIVSTELNKISKRLTQDPSQPASQAMMYGAGFTDEDMKKPIVGIGSTGFDGNTCNMHLNILAGQVKGSITRGGMVGLGFNTIGVSDGISMGTEGMRFSLVSRDVIADSIETICEAHYYDALVTVVGCDKNMPGALIAMARLNRPSIMVYGGTIHSGHYKGEKLNIVSAFEALGKKVAGTITEEDYQGVIKNACPGAGACGGMYTANTMASAIEAMGLTLPYSSTAPATSEKKKAETLALGKAMMHLLEKDIKPRDIMTFEAFENAIRVILVLGGSTNAVMHLIAIAKAAGVKLTIDDFQRIGNTTPLLADLKPSGKYMMEDMDAIGGVPSVMRLLAKHNLLHLDCMTVTGKTVGENLKEAQDLPTDQDLMYAWENPIKQTGHLQILYGNLAPQGSVAKITGKEGTYFEGPARVYDSEEAVNKGLEANEVKSGEVIVIRYVGPKGGPGMPEMLKPTALLMGLGLGNECALITDGRFSGGTHGFVVGHITPEATEGGMIGLVKNGDIIRIDAVNRVLEVKISEEEVTKRRAAWVKPAPRATSGVLYKYMKLVSSASEGCVTDN

SEQ ID NO: 239 - DNA, 1764 bp, Rhodopirellula baltica
ttgaccctttcaaggtgttgccacccatcttcggccgctttcccctgccaaaacgatctcatgaccgcgtctcagcctgaatccgattccaatgcactgaacaagtacagcagcaagatcacccagccgaaaagccagggtgcgtcgcaggcgatgctttacgccaccggcatgtcctcggaggatatgaacaagcctcaagtcggcatcggcagcatgtggtacgagggcaacagctgcaacatgcacctgctcgatctcgcagcggatgttaaagctggagtcaccgacgccggaatggtcggaatgcgtttcaacaccatcggtgtctcggacggcatctcgatggggaccgacgggatgagcttctcactgcaaagtcgcgacctgatcgccgactcgatcgagacgatcatgggggcgcagtggtacgacgcgttgatcaccctgcccggctgcgacaagaacatgcccggctgtttgatggcgatgggacgtctgaaccgtccttccatcatggtctacggtggaacgattaaacctggcagctaccgcgacgagaagctggacatcgtcagcgcgttccagtgctacggccagttcatcgcgggacaaatcagcgaagaagaacgcagtgaaatcgttcgccgcagttgcccaggtgcgggagcatgcggcggcatgtacaccgccaacacgatggccaccgcaatcgaagccttgggcatggccctgccctactccgccagcatccctgcagagcatccagaaaagaaagaggaatgcaaacgtgccggtttggccatcctcgaactgttgaagaaggacatcaagcctcgcgacatcatgactcgcggtgcattcgaagacgcgatggtgacattgatggcactgggcggcagcaccaacgcggtgcttcacttgatcgcgatggctcgcagcgtcgatgtgccactgacgattgaagacttccaatcggtcagcgaccgcacacctttcttggccgacctgaaacccagcggcaagttcgttcaagaagacctgcacagcgtcggtggcacgcccgcggtgatgaagtacttgctcgaaaagggcatgatcaaaggcgagcacatgaccgtcaccggcaagactctcgcggagaacctggccgatttgcctggtttgaagaccggccaaaagatcgtgtcgacggtcgaagagccgatcaaaaaatcgggtcacattcgaatcctgaaaggatcactggccacggaaggcgcggtcgcgaaaatcactggcaaagaaggtctgcagttcagcggaccggctcgtgtctatgacaatgaggaattgatgctcgccgctttggaacaaaagcagattcaaaagggtgacgtcgttgtgatccgctacgaaggtcccaagggcggacccggcatgcctgagatgttgactccaaccagtgccatcatgggtgctggtttgggaagcgacgtcgcgatgctgactgacggccgtttcagcggcggtagtcacgggttcatcgtggggcacatcactcccgaagcacaagttggtggtccgatcgcattgatcgaagatggagacacgatcacgattgatgccgaaaccaactcgttggacttagaagtcgatgcggctgaattggaagcccgccgatccaagtggaccgcaccgccactgaaagccacccgcggaacgctctacaagtacatcaagtgcgtgaagagcgccagcgaaggctgcgtcaccgacgagtga

SEQ ID NO: 240 - protein, 587 aa, Rhodopirellula baltica
MTLSRCCHPSSAAFPCQNDLMTASQPESDSNALNKYSSKITQPKSQGASQAMLYATGMSSEDMNKPQVGIGSMWYEGNSCNMHLLDLAADVKAGVTDAGMVGMRFNTIGVSDGISMGTDGMSFSLQSRDLIADSIETIMGAQWYDALITLPGCDKNMPGCLMAMGRLNRPSIMVYGGTIKPGSYRDEKLDIVSAFQCYGQFIAGQISEEERSEIVRRSCPGAGACGGMYTANTMATAIEALGMALPYSASIPAEHPEKKEECKRAGLAILELLKKDIKPRDIMTRGAFEDAMVTLMALGGSTNAVLHLIAMARSVDVPLTIEDFQSVSDRTPFLADLKPSGKFVQEDLHSVGGTPAVMKYLLEKGMIKGEHMTVTGKTLAENLADLPGLKTGQKIVSTVEEPIKKSGHIRILKGSLATEGAVAKITGKEGLQFSGPARVYDNEELMLAALEQKQIQKGDVVVIRYEGPKGGPGMPEMLTPTSAIMGAGLGSDVAMLTDGRFSGGSHGFIVGHITPEAQVGGPIALIEDGDTITIDAETNSLDLEVDAAELEARRSKWTAPPLKATRGTLYKYIKCVKSASEGCVTDE

SEQ ID NO: 241 - DNA, 1683 bp, Blastopirellula marina
atgtccgccccgctcaacaagtacagcagccgcgttacccagccaaaaagccagggcgcgtcgcaggccatgctttacggaaccggcatgaccgacgccgacatggacaaagcgcaggttggcatcgccagcatttggtacgagggcaacacgtgcaacatgcacctgaatcagctctcggaagtggtgaaaaaaggggtggtaggcgccgacatggtcgggatgcggttcaacacgatcggcgtgagcgacggcatctcgatggggaccgaagggatgagcttctcgctccaatctcgcgacctgatcgccgactcgatcgaaacggtcatgggcggtcagtggtacgacggactgatcgcgctgccgggctgcgacaaaaacatgccgggatgtttgatcgcgatggggcgtttgaaccgtccgtcgatcatggtctacggcggtacgatcaaaccgggccacaccagcaagggagagaagctcgacatcgtctcggctttccagtgctacgggcaattcctctcggaaggaatcaccgaagaagaacgcaaagaaatcgtgcacaaagcttgtcctggagcgggcgcttgcggcggcatgtacaccgccaacacgatggcgacggcgatcgaagcgatgggcatgacgctgccttacagcagcagcattccggccgaagatccggcgaagcagcaagaatgcatcgacgccggcaaagcgatgcgctacttgctggagaaagatattaagccgcgcgacatcatgacccgtgatgcgtttgaaaacgcgatggtcacggtgatggcgctcggcggttcgaccaacgccgtgttgcacttgatcgcgatggctcgcgcggtggatgtcgacctgtcgatcgacgacttccaaacggtcagcgatcgcgtccctttcttggccgatctgaagccgagcggcaagtttgtgcaagaagatctgcactcgatcggcggtacgccggccgtcctgaagtatctgctggccgaaggcttcttgaagggggactgtatgacggtgaccggcaagacgctggccgaaaacatcgccgatcttcccggcttgaaagaaggccagaagatcgtccacccactgtcggacccgatcaagtcctccggtcacatccagatcttgaagggcacgctggcccccgaaggcgccgtcgccaagatcaccggcaaagaaggactccgctttcaagggccggccaatgtctttgatagcgaagaagacatgttgcacgcgctggaagacaagaagatcaaaaagggagacgtcgtcattattcgctacgaaggtcccaagggaggccccggcatgccggagatgctgactccgacctcggcgattatgggggccggtctcggcagcgatgtcgcactgctgaccgatggccgcttctccggcggctcgcacggtttcatcgttgggcatatcacgcctgaggcgcaagacggaggcccggtcgcgctcgttcaaaatggcgacatcgtcacgatcgacgccgacaccaactcgattgacgtcgacgtgccggccgatgagatggcgaaacgcttggccgcttggaaggctccggcctacaaagcgacccgcggcacgctttacaagtacatcaagaatgtgaaaagcgcttcagaaggttgcgtgaccgacgaataa

SEQ ID NO: 242 - protein, 560 aa, Blastopirellula marina
MSAPLNKYSSRVTQPKSQGASQAMLYGTGMTDADMDKAQVGIASIWYEGNTCNMHLNQLSEVVKKGVVGADMVGMRFNTIGVSDGISMGTEGMSFSLQSRDLIADSIETVMGGQWYDGLIALPGCDKNMPGCLIAMGRLNRPSIMVYGGTIKPGHTSKGEKLDIVSAFQCYGQFLSEGITEEERKEIVHKACPGAGACGGMYTANTMATAIEAMGMTLPYSSSIPAEDPAKQQECIDAGKAMRYLLEKDIKPRDIMTRDAFENAMVTVMALGGSTNAVLHLIAMARAVDVDLSIDDFQTVSDRVPFLADLKPSGKFVQEDLHSIGGTPAVLKYLLAEGFLKGDCMTVTGKTLAENIADLPGLKEGQKIVHPLSDPIKSSGHIQILKGTLAPEGAVAKITGKEGLRFQGPANVFDSEEDMLHALEDKKIKKGDVVIIRYEGPKGGPGMPEMLTPTSAIMGAGLGSDVALLTDGRFSGGSHGFIVGHITPEAQDGGPVALVQNGDIVTIDADTNSIDVDVPADEMAKRLAAWKAPAYKATRGTLYKYIKNVKSASEGCVTDE

SEQ ID NO: 243 - DNA, 1692 bp, Planctomyces maris
atgtcagccgattcgcaacccgttttgaacaagtacagttcccgtatcacacagccccgttcgcagggtgcctcgcaagccatgctctacgccaccggcatgagcgaagaggatatgaacaaggcccaggtcggaatttccagcgtctggtacgaaggcaattcctgcaacatgcacctcaacaaactggctgccaaggtcaaagagggcgtcgaagccgccgatctggttggcctgcggtttaataccatcggtgtgagcgacgggatttccatgggcaccgacggcatgtcctattcgctgcagtcccgcgacctgatcgccgacagtatcgaaacagtcacctgtgcccagtggtacgatgccaacatttcgctgcctggctgtgataagaacatgcctggctgcctgattgccatgggacgatttaaccgcccctcgatcatggtttacgggggaacgattgctcccggctgtctgaataatcagaagctggacattgtctccgcatttcagtcttacggcgaatacctggctggtacgatcacagatgaaacccgaaaagaaatcgtacagaaaagctgtccgggcgctggtgcctgcggcggcatgtataccgccaacacgatgtcgtctgccatcgaagctctggggatgtcactcccttacagttcttccattcctgcagagcatcccgataaactcgatgagtgtatccgcgctggtgccgccatcaggaaactgctggaactggatctgaaaccccgcgacatcatgacccgcgaggctttcgaaaatgcgatggtactgattgtcgcactggggggatcgaccaacgccgtgctgcacatgctggccatcgcccgttctgtcggcctggaactgactattgatgacttccagtccgtcagcgatcgtattcctttgctggccgatttcaaacccagtggtaaatacgtgatggctgacctgcaggagattggcgggacaccagccgtgatgaaatacctgctggaaaaaggcctgatcaacggcgactgcatgacggtcacgggaaaaacagtggccgaaaacctggcagaactaccgggcctcaaagagggtcaggatatcattcacgctgtcgaaaacccgatcaagccgaccggtcacctgcagatacttaaaggcaacctggctccgacaggtgccgtcgccaagatcaccggtaaggaaggcctggtcttcgaagggaccgccaacgtcttcgattccgaagaggacatgctcaaagccctcgaagacaagcagattcaaaaaggcgatgtgatcatcatccgctacgaaggccccaaagggggaccagggatgcccgaaatgctgaccccgacttccgccatcatgggagccggcctgggtaaggatgttgccctgctgaccgacggtcgtttttctggtggttcacacggctttatcgtcggacatatcactcctgaagcacaggaaggcggtccaatcgccctggtcaaaaatggcgacaaggtcattatcgacgccgacaaaaatcgactggagatggatgtcagtgatgcagagctcgaagaacgtcgcaaagcctggacggcccctccgtttaaatacacgcggggtacactttacaaatatatcaagaatgtgaaatccgcttctgaaggttgtgtgaccgacgagtaa

SEQ ID NO: 244 - protein, 563 aa, Planctomyces maris
MSADSQPVLNKYSSRITQPRSQGASQAMLYATGMSEEDMNKAQVGISSVWYEGNSCNMHLNKLAAKVKEGVEAADLVGLRFNTIGVSDGISMGTDGMSYSLQSRDLIADSIETVTCAQWYDANISLPGCDKNMPGCLIAMGRFNRPSIMVYGGTIAPGCLNNQKLDIVSAFQSYGEYLAGTITDETRKEIVQKSCPGAGACGGMYTANTMSSAIEALGMSLPYSSSIPAEHPDKLDECIRAGAAIRKLLELDLKPRDIMTREAFENAMVLIVALGGSTNAVLHMLAIARSVGLELTIDDFQSVSDRIPLLADFKPSGKYVMADLQEIGGTPAVMKYLLEKGLINGDCMTVTGKTVAENLAELPGLKEGQDIIHAVENPIKPTGHLQILKGNLAPTGAVAKITGKEGLVFEGTANVFDSEEDMLKALEDKQIQKGDVIIIRYEGPKGGPGMPEMLTPTSAIMGAGLGKDVALLTDGRFSGGSHGFIVGHITPEAQEGGPIALVKNGDKVIIDADKNRLEMDVSDAELEERRKAWTAPPFKYTRGTLYKYIKNVKSASEGCVTDE

SEQ ID NO: 245 - DNA, 1680 bp, Algoriphagus sp.
atgaccctgaaaaaacacagttgggaaatcagcgacaattcggagcatccggctgggatggctatgttgtatgccaccggaatgagcgataaaaagatgaaacagccatttgtagggatagcgagttgcggctatgaaagtaatccctgcaatatgcatttgaacgactttgccggtctgatcaaagcttcttcacaagagcaagatctgaccggtttagtttttaataccattggtatttctgacggaaccacgatgggaaccttggggatgcgttattcactggtttctagggagataattgctgattctatagagtcttttatcatagggcattcatttgatgcttgtatttctgttgcaggatgtgacaagaatatgcctggtgcattgatggggatgatccgtactaacagaccttctattttggtgtatggaggaacgatagcctctggacattataagggagaaaagctaaatatcgtttcggcatttgaagcctttggaaagcgagtgaatggaaacatttctgatgaagattatgatggtgtcatcagaaacgcatgtccaggaaaaggagcttgtggaggtatgtatactgccaataccatgtcttcagcaattgaagcgatgggaatgtcattgccttactcctcttcttatccggcaaactctccagaaaaattgagggagtgtggagaagtgaataaatatatgagaatccttttagaaaaggatttgaaacctagtgatatcatcactagaaaaagtattgaaaatgcagtaaccgtagcaattgccttaggtggtagtaccaatgcggtaatgcatatcattgcgatcgcccgaactgccggtgtagattttaccattgaggattttaaagcaatcaatgcaaaaactccaatgattggtgatttcaaaccttctggaaaattcatgatggaagaccttcacgaacaaggtggacttcctgcctttatgaagtatatgttgcagaatgggttcattcatggagattgcttaactgtgactggaaagacggttgcagaaaaccttgagaatattgaacctgtgactccatcgatggtgaatgttattcatcctttggaaacgccgataaaagcaacgggtcatttatgtgtgctttcaggaaatcttgctccagaaggagcggttgccaaaattacaggtaaagaaggaagttcttttacaggacctgcacatgtttttgactcagagcaggatgccaatgatgctatcagagatcataaaattgagaagggtgaagttattgtcattcgaaatatcggacccaaaggtggtccaggaatgcctgaaatgttgaagcctacttctatgattataggagctggtttaggatcagacgttgccttaattactgatggaagattttccggaggaacacacggatttgtggtagggcacgttacaccagaagcgtttagcggaggacctatcggattggtcagaaatggagatatcatcacgatagatgctgataacttacagctgagcgttgcgatttctgaagaggagtttgaagaaagaaagaaaacttggaaacgaaaagaaatttctgatttgcaagggactttgaaaaaatacaataaacttgttgccactgcatctgaaggttgcgtgacagataaattctaa

SEQ ID NO: 246 - protein, 559 aa, Algoriphagus sp.
MTLKKHSWEISDNSEHPAGMAMLYATGMSDKKMKQPFVGIASCGYESNPCNMHLNDFAGLIKASSQEQDLTGLVFNTIGISDGTTMGTLGMRYSLVSREIIADSIESFIIGHSFDACISVAGCDKNMPGALMGMIRTNRPSILVYGGTIASGHYKGEKLNIVSAFEAFGKRVNGNISDEDYDGVIRNACPGKGACGGMYTANTMSSAIEAMGMSLPYSSSYPANSPEKLRECGEVNKYMRILLEKDLKPSDIITRKSIENAVTVAIALGGSTNAVMHIIAIARTAGVDFTIEDFKAINAKTPMIGDFKPSGKFMMEDLHEQGGLPAFMKYMLQNGFIHGDCLTVTGKTVAENLENIEPVTPSMVNVIHPLETPIKATGHLCVLSGNLAPEGAVAKITGKEGSSFTGPAHVFDSEQDANDAIRDHKIEKGEVIVIRNIGPKGGPGMPEMLKPTSMIIGAGLGSDVALITDGRFSGGTHGFVVGHVTPEAFSGGPIGLVRNGDIITIDADNLQLSVAISEEEFEERKKTWKRKEISDLQGTLKKYNKLVATASEGCVTDKF

SEQ ID NO: 247 - DNA, 1677 bp, Candidatus Sulcia muelleri
atggcgattaatacatttagtattaaattaactaaaaatagtactttacctgctgcacaagcaatgctgtatgctactgggttaaaagaatatgattttaatcaagctcaagttggcatagttagtaattggtatgaaggtaatccatgtaatattcatttacatattattagtaataatataaaatcatctataaaaaaaaatggaatggtggggtttaaatttaatactataggtattagtgatggtatgtctatgggaacatctggaatgagatattctttaccatcaagagaattaatagctgatagtatagaaagtgttgttaaaactcaacattatgatggattaataggaattccaggatgtgataaaaatatccctggaatagttatggcaatgttacgtattaatagaccttctatattagtatatggaggtagtatatcatcaggatattataatggtaaaaaattaaatatagtttctgcttttgaagctttaggagaaaaaaatataggtaaaatttcagaattagaatataaaaatataattaaacatgcttgtcctggtccaggagcttgtggaggaatgtatacagctaatacaatggcttcttgtcttgaagcaatgggaataacaattccatattcatcttcatcattagctaatagtagctttaaaaaaaaagaatgtattaatataggttattatataaataatatattaaaaaataatattaaaccattggatattattacttataaatctataaaaaatgctataactctagcaatagcattaggaggatcaacaaatttagtaatacatattttagcaatagctaaaactgctaatttagatctaaaattagatgatattcaaaatatcaataataatgttccaattatagctaatttaaaaccaagtggagattttttaatggaagatatacaatctatgggaggaattcctataattataaaatatttattaaaagaaggatatatagaaggagactgtattactgtaacaggaaacacaataaaaaaaaatttagaaaatatacctgatctttcttttaaagaaaaaattatatatcctttattaaatcctataaaaaaaaatgggcatatacgtattttatatggtaatatagccccttatggagctgttgctaaaattactggaaaagaaggtgatattttttcaggatttgcacaagtttttaattcagaaaactctgctaataaagcaataattaataataaaattaaagaaggagatgtaatagtaattagatatgtaggtcccagaggaggtcctggaatgcctgaaatgcttaaacctacttcttacataatgggggctaatttaagtaaaaaaattgctttaataactgatgggagattttcaggaggatctcatggatttgtagtaggtcatattactccagaggctcaaaatggaggattaattgctttaatagaaaatggagatattataataattgatgcaataaagaatactataacattaaaaatatcaaaaaaagaaataaaaaatagaaaaaaaacacccttgcgagtgcgaggtaaagtaaattcaggttatttatataagtatacaaaaactgtatcatctgcttataatggatgtgtaacagataaattgtaa

SEQ ID NO: 248 - protein, 558 aa, Candidatus Sulcia muelleri
MAINTFSIKLTKNSTLPAAQAMLYATGLKEYDFNQAQVGIVSNWYEGNPCNIHLHIISNNIKSSIKKNGMVGFKFNTIGISDGMSMGTSGMRYSLPSRELIADSIESVVKTQHYDGLIGIPGCDKNIPGIVMAMLRINRPSILVYGGSISSGYYNGKKLNIVSAFEALGEKNIGKISELEYKNIIKHACPGPGACGGMYTANTMASCLEAMGITIPYSSSSLANSSFKKKECINIGYYINNILKNNIKPLDIITYKSIKNAITLAIALGGSTNLVIHILAIAKTANLDLKLDDIQNINNNVPIIANLKPSGDFLMEDIQSMGGIPIIIKYLLKEGYIEGDCITVTGNTIKKNLENIPDLSFKEKIIYPLLNPIKKNGHIRILYGNIAPYGAVAKITGKEGDIFSGFAQVFNSENSANKAIINNKIKEGDVIVIRYVGPRGGPGMPEMLKPTSYIMGANLSKKIALITDGRFSGGSHGFVVGHITPEAQNGGLIALIENGDIIIIDAIKNTITLKISKKEIKNRKKTPLRVRGKVNSGYLYKYTKTVSSAYNGCVTDKL

SEQ ID NO: 249 - DNA, 1650 bp, Candidatus Carsonella
atgaaatcaaaattaataacaaaatggccaataaaagcagcaaatagagccatgttgcgtgcagttggatataacgattatgattttaataaatttcaagttggaattgcatcaacttggagtaatataacaccttgtaataatcatatcaatgtattagctaaagcagttgaatatggagtaaattcaaaattttgtaaaggaacaatatttaatacaataacagtatctgatggaatatcaaatggtaattttggaatgaaatattcattactatcaagagatataatttcaaattcaatagaagttgttggcaaagcacaaaattttgatggtattatttctattggaggatgtgacaaaaatattcctggttgtattattggaatgtgtaatttagaaattccttcaatttttatatatggtggtacaattttaccaggcaaaaatagaacagatattgtctctgtttttgaatctttgggtaaattttataataaaactattaatgaaaaagaattgttaaatattgaaaaaaactccattattggatctggatcatgtagtggaatgtatacagcaaattcaatggcaattgttgcagaatgcctaggaattagcttaccaaactcttctattcaaaatgcgcaatcaattaataaaattgttaattgtattaattctggtaaattaataaaaatattgttagaaaataatattacaataaaaaaaattattaataaagaatctattttaaattctataaaagtaatttcattattaggtggatcaacaaattgtttaattcatttattagcaattgctaattgtttaaaaataaatttatctttaaaagatttacaatttgaaactaataacttaccaacgttatctgatttaaaaccaagtggaaaattttttatttcagatttaattaatactggtggaatacaaaaatttttaaaatatttaattgatattaatttaataaatggtaatttattaacggttacaggtaattcattaaaagaaaatttaaaatttattaaaataaattataaaaataaaatactaaaagatatcaataatcctgttaaaaaaactaatcaaatcaaaatattatttggaaacttatcaataaatggttgtatatcaaaaatatcgggtaaagaaggagaaatattctttggaaaagcactagtatttaattcagaagaagaatctgttaattatatttataaaaaaaaaattcaaaataacacaattataattataaggtatgaaggtccaaaaggaggccctggaatgagagaaatgttaactcctacttctgctttaataggagttggaaagaaaaattctgttgctttaataacagatggtagattttcaggtggaagccacggatttgttgtaggacatatttcgccagaagcatatgattttggtacaatttgtttaattaataataatgatctaataataatagatactataaacaattttattagtttatttttaaacaaaagaagcttaaaaagtagattttataaagttaaaatatttaacaaaatagtttcaggtattttaaatttatataaaaaatattcgatttgctcatcgaaaggtgcattattaaattatgaataa

SEQ ID NO: 250 - protein, 549 aa, Candidatus Carsonella
MKSKLITKWPIKAANRAMLRAVGYNDYDFNKFQVGIASTWSNITPCNNHINVLAKAVEYGVNSKFCKGTIFNTITVSDGISNGNFGMKYSLLSRDIISNSIEVVGKAQNFDGIISIGGCDKNIPGCIIGMCNLEIPSIFIYGGTILPGKNRTDIVSVFESLGKFYNKTINEKELLNIEKNSIIGSGSCSGMYTANSMAIVAECLGISLPNSSIQNAQSINKIVNCINSGKLIKILLENNITIKKIINKESILNSIKVISLLGGSTNCLIHLLAIANCLKINLSLKDLQFETNNLPTLSDLKPSGKFFISDLINTGGIQKFLKYLIDINLINGNLLTVTGNSLKENLKFIKINYKNKILKDINNPVKKTNQIKILFGNLSINGCISKISGKEGEIFFGKALVFNSEEESVNYIYKKKIQNNTIIIIRYEGPKGGPGMREMLTPTSALIGVGKKNSVALITDGRFSGGSHGFVVGHISPEAYDFGTICLINNNDLIIIDTINNFISLFLNKRSLKSRFYKVKIFNKIVSGILNLYKKYSICSSKGALLNYE

SEQ ID NO: 251 - DNA, 1674 bp, Synechococcus sp.
atgctccgctccgacgccgtcacgcagggaatctcccgctcccccaaccgcgccatgttgcgtgcggtcggttttggtgacgccgacttcggcaagccgatcatcggcatcgccaacggctacagcaccatcaccccctgcaatgtggggctgaacgatctggcgatgcgagctgaagcgtcagcgcgtcaggccggcggcatgccccaaaccttcggaaccatcaccgtcagcgatggcatttcgatgggcacggaaggaatgaagtactccctggtgagcagggaagtgatcgctgacgcgatcgaaacggcctgcaatggccagagcatggatggggtgctcgctgtcggtggctgcgacaaaaacatgcccggcgccatgctcgcgatggcccgcatgaacatcccgtccatttttgtctatggcggcaccatcaaacccggcaaactcggcggctgtgatctcaccgtggtgagtgcctttgaggccgtaggtcagatcaccagcggcaagattgacgaagaacagctaacggcgattgaaaagaatgcctgccccggtgcaggcagctgtggcggcatgttcaccgccaacaccatgagtgctgcgatcgaaaccctcggtctgagcctgccctacagctccaccatggcggcggaagactccgagaaggctgatagcgcagcccgttcagccgaggtgcttgttgatgccatcaaagccaacattcgcccgcttgatctactcaccaaggaagcgtttgaaaacgccatcagcgtgattatggccgtgggtggctccaccaattcagtgctccacctgctcgccattgcccgcactgccggcgtcgatctgagcatcgacgattttgagcgcatccgtcagcgggtcccggtgatctgtgacctcaaacccagtggccgttttgtcacggttgatcttcatcaggctgggggcattcctcaggtgatgaaattgcttctggatggaggactactccatggcgagtgccgcaccatcgaaggcaaaagcctgaaggaactgttggctgatgtgccttcggttccgcctgctgatcaggaggtcattcgcccactgtccaatcccttgtacgccaaggggcacctggccatcctcaaaggcaacctcgcctcagaaggtgccgtcgcaaagatcagcggtgtgaaaaatccggtgatcaccggtccggcacgggtgttcgaaagcgaagaaacctgccttgccgccatcctcgacaaccaggtcaaggccggtgatgtggtggtcgttcgcaacgaaggcccggtgggtggtcccggcatgcgggaaatgctcagccccacatccgcaattgtgggacagggcctgctcgacaaagtggccctgattaccgacggacgtttctccggtggttcctacggcttggtgatcggccacgtggcgccagaagccgccgtcggtggcaccatcggcctagtgcatgaaggcgacagcatcactgtcgacgccaacaaactgctgattcaactgaacatcgacgaagccgaactggaacgccgccgtaacgcctgggcgcctgcgaccccgaagtaccgcacagggatcctgggcaaatatgcgcgcctggtctcaagttccagccgcggcgccaccaccgacatcgcggactaa

SEQ ID NO: 252 - protein, 557 aa, Synechococcus sp.
MLRSDAVTQGISRSPNRAMLRAVGFGDADFGKPIIGIANGYSTITPCNVGLNDLAMRAEASARQAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETLGLSLPYSSTMAAEDSEKADSAARSAEVLVDAIKANIRPLDLLTKEAFENAISVIMAVGGSTNSVLHLLAIARTAGVDLSIDDFERIRQRVPVICDLKPSGRFVTVDLHQAGGIPQVMKLLLDGGLLHGECRTIEGKSLKELLADVPSVPPADQEVIRPLSNPLYAKGHLAILKGNLASEGAVAKISGVKNPVITGPARVFESEETCLAAILDNQVKAGDVVVVRNEGPVGGPGMREMLSPTSAIVGQGLLDKVALITDGRFSGGSYGLVIGHVAPEAAVGGTIGLVHEGDSITVDANKLLIQLNIDEAELERRRNAWAPATPKYRTGILGKYARLVSSSSRGATTDIAD

SEQ ID NO: 253 - DNA, 1671 bp, Synechococcus sp.
atgctccgctccgatgccgttaccaaggggattcagcgctcacccaatcgggcgatgctgcgagccgtcggtttcggcgatcaggacttcggaaaaccaatcattggcatcgccaacggctacagcacgatcacgccctgcaacgttgggctcgatgatctcgccaggcgtgccgaagaggcggcccgcctagcgggaggtatgcctcaaacgttcgggaccatcaccgtcagcgacgggatctcgatgggaacagagggaatgaaatattccctggtgagccgggaagtgatcgccgacgccatcgaaacagcctgcaatggccagagcatggacggcgtgttggccgtgggcggctgcgacaagaacatgcctggagccatgctcgcgatggcgaggatgaacatcccggcgatcttcgtgtacggcggcaccatcaagcccggaaaactcggcggctgcgacctcaccgtggtcagtgcttttgaagcggtcggtcagatcaccagcggcaagatcgacgaggagcagctcacggccatcgagaaaaatgcctgccccggggctggcagctgcggcggcatgttcaccgccaacaccatgagcgccgccatcgaaacgatgggactcagccttccgcacagctccaccatggctgctgaagatgaagagaaggccgagagcgcagcccgatcggcggaggtgttggtgcaggccatcgaatccggcatccgccccctcgacctgatgacccgtgaggccttcgaaaatgccatcagcgtgatcatggcggtgggtggttccaccaattccgtgctgcatttgctcgccattgcccgcactgctggggtggagctcgccatcgacgactttgaacggatccgccagcgcgttccagtgatctgcgacctcaaacccagtggccgttacgtcacggtggacctccaccgcgccggtggaattccccaggtgatgaaactgctgctggatgccggactcctccacggtgattgccgcaccatcgaaggcaaaaccctgaaggagctgcttgccgatgtgccctccactccgcccgcggatcaggatgtgattcggccgctctccaatcccctttatgccaagggccacctggccatccttaagggcaatctggcttccgaaggagctgtcgcgaagatcagtggtgtgaagaatccggtgatcaccggtccagcaagggtgtttgagagcgaagaaagctgtcttgaagcgattctcgacaatcagatcaaggccggtgatgtggtggtggtgcgcaatgaaggcccggtcggcggaccgggcatgcgcgagatgctcagtcccacgtccgcgatcgtgggacaagggctactcgacaaggtggcgctgatcaccgacggacgcttttcaggtggctcctatggcctcgtgattggccatgtagcccccgaagcggccgtgggcggaaccatcggtttgatcgaggaaggagacagcatcaccgtggacgccaatcagctgctgctgcaactgaatgtggaggaggctgagctggagcggaggcggagtgcatggtcggcaccagtgccgaagtaccgcacggggatcctcggcaaatatgcccggcttgtgagttccagcagccagggtgcggtcaccgaccagccctga

SEQ ID NO: 254 - protein, 556 aa, Synechococcus sp.
MLRSDAVTKGIQRSPNRAMLRAVGFGDQDFGKPIIGIANGYSTITPCNVGLDDLARRAEEAARLAGGMPQTFGTITVSDGISMGTEGMKYSLVSREVIADAIETACNGQSMDGVLAVGGCDKNMPGAMLAMARMNIPAIFVYGGTIKPGKLGGCDLTVVSAFEAVGQITSGKIDEEQLTAIEKNACPGAGSCGGMFTANTMSAAIETMGLSLPHSSTMAAEDEEKAESAARSAEVLVQAIESGIRPLDLMTREAFENAISVIMAVGGSTNSVLHLLAIARTAGVELAIDDFERIRQRVPVICDLKPSGRYVTVDLHRAGGIPQVMKLLLDAGLLHGDCRTIEGKTLKELLADVPSTPPADQDVIRPLSNPLYAKGHLAILKGNLASEGAVAKISGVKNPVITGPARVFESEESCLEAILDNQIKAGDVVVVRNEGPVGGPGMREMLSPTSAIVGQGLLDKVALITDGRFSGGSYGLVIGHVAPEAAVGGTIGLIEEGDSITVDANQLLLQLNVEEAELERRRSAWSAPVPKYRTGILGKYARLVSSSSQGAVTDQP

SEQ ID NO: 255 - DNA, 1674 bp, Synechococcus sp.
atgcttcgctcagacgccgtcactcaaggcattcagcgctcacccaatcgagcaatgctgagagcggttggcttcggtgatgaagatttcggcaagcccattatcgggatcgctaacggttacagcacgattacaccttgcaatgtgggattgaatggtctgtcccgtcgtgccgaagattcggctcgaaaggcaggtggaatgcctcagactttcggaaccatcaccgtcagcgatggcatctcgatgggcacggaaggaatgaaatattccttggtgagccgtgaagtgattgctgatgcaattgaaacggcctgcaatgggcaaagtatggatggcgttctggcggttggtggttgcgataaaaatatgcctggcgccatgttggcgatggcacgtatgaatatcccctcgatttttgtgtacgggggaacaattaagccgggaaaattaggtggctgtgacctcactgttgtgagtgcttttgaggctgtcggtcagattacgagtgggaaaattgatgaagagcagctaactgcgattgaaaaaaatgcctgcccaggtgctggcagctgtggaggcatgttcacggccaatacgatgagtgctgcgattgaaacgatggggctgagtcttccccacagttcaacgatggctgccgaagatgaggaaaaagcagagagtgcggctcgttctggtgaagtcctcgttgaggcaattaaatccaatattcgcccccttgatttgctcacgcgggaagcctttgaaaatgccatcagcgtgatcatggcggtgggcggctccaccaactctgtgttgcatttgcttgctatcgcgcgcacagcaggcgtggatctcagcatcgacgactttgaacagatccgccaacgcgttccggtgatttgtgatctaaaaccgagtggtcgttttgtcaccgtggatcttcatcaggctgggggcattccacaggtgatgaaattgcttttagatgcgggcttgctccatggcgattgccgcacgattgaagggaaaacattgaaagaattgttggctgatattccttcaacgcctcctgaaggacaagaagtgattaggccgttaagtaaccccctttatgccaaagggcatttggccattctgaaaggaaatttggcaagcgaaggagctgtcgccaaaatcagcggcatcaaaacgcctgtcctcacaggtcctgctcgcgtttttgaaagcgaagaggattgtttagcgtcgattattggtaaacatattcatgctggtgatgtcatcgtgattcgccaggaaggtccagtgggaggtcctggaatgcgcgaaatgcttgcaccaactgctgccattgttgggcagggactcggtgacaaggtggcgctgattacggatggtcgattcagtggtggaacctatggtttggtggttggccacgtggctccagaagctgccgttggtggagcaatcggccttgttatggaaggagacagcatcactgtggatgccaatcaaaaccttcttcaactcaatgtgaatgaggctgaactcgaaacacgccgccgcacttggtcaggacataagcctagatacaagactggaattcttggcaaatatgctcgacttgtctcgagttctagtcgtggtgccgtgacagatcagcctgattaa

SEQ ID NO: 256 - protein, 557 aa, Synechococcus sp.
MLRSDAVTQGIQRSPNRAMLRAVGFGDEDFGKPIIGIANGYSTITPCNVGLNGLSRRAEDSARKAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETMGLSLPHSSTMAAEDEEKAESAARSGEVLVEAIKSNIRPLDLLTREAFENAISVIMAVGGSTNSVLHLLAIARTAGVDLSIDDFEQIRQRVPVICDLKPSGRFVTVDLHQAGGIPQVMKLLLDAGLLHGDCRTIEGKTLKELLADIPSTPPEGQEVIRPLSNPLYAKGHLAILKGNLASEGAVAKISGIKTPVLTGPARVFESEEDCLASIIGKHIHAGDVIVIRQEGPVGGPGMREMLAPTAAIVGQGLGDKVALITDGRFSGGTYGLVVGHVAPEAAVGGAIGLVMEGDSITVDANQNLLQLNVNEAELETRRRTWSGHKPRYKTGILGKYARLVSSSSRGAVTDQPD

SEQ ID NO: 257 - DNA, 1674 bp, Synechococcus sp.
atgcttcgctccgacgccgtcaccaaggggatccagcggtctcccaaccgcgccatgttgcgggccgtgggctttggagacagtgatttcggcaagcccatcctgggcattgccaacggctacagcactatcaccccctgcaatatcgggctgaacgacctggccaaacgggctgaggaagcagcccgccaggccggaggcatgccccagatgtttggaaccatcaccgtgagtgatggaatctccatgggcactgaagggatgaagtactccctggtgagccgtgaagtgattgctgacgccatcgaaacggcctgcaacggtcagagcatggatggggtgctggccgttggtggctgcgacaagaacatgcctggcgccatgctggccatggctcggatgaacattccttcggttttcgtctacggcggcacgatcaagccgggcaagctcgggggctgtgatctcacggtggtgagcgcttttgaggcggtggggcaactcaccagcggcaagatcgacgaagtgcagctcaccgcagttgagaaaaatgcctgccctggggctggcagttgcggcggcatgttcaccgccaacaccatgagtgccgccatcgaaacgatggggctgagccttccctacagctccacgatggcagccgaggacgaggaaaaggccgacagtgccgctcgctccgctgaggtgctggtggaggcagtgaaagccaacattcgccctctggacctgctcaccaaggaagcctttgagaacgccattagcgtgatcatggcggtgggtggctccaccaatgcggtactgcacctgctggccattgcccgtaccgccggcgtcgacctgagcatcgatgacttcgaacggatccgtcagcgggtgccggtgatctgtgatctcaagcccagcggccgctacgtgaccgttgatctgcacaacgccggcggcattccccaggtgatgaagctgctgctggatgctggcttgctgcacagcgactgccgaaccgtggaaggcaaaagcctgaaggagttgctggccgatgtgccgtcggagccccccgccgggcaggaggtgatccgccccctcagcaatccgctgtacgccaaaggtcacctcgccatccttaagggcaacctcgccagcgagggaagcgtggccaagatcagcggcgtgaaaacccctgtgctcactggccctgcgcgggtgtttgaaagcgaggaagactgccttgccgccatcctcgataaaaagatccaggccggggatgtggtggtggtccgcaacgagggtcccgttggtggaccgggcatgcgggaaatgctggctccaacttcagcgattgttggtcagggcctgggggacaaggtcgccctgatcaccgatggccgctttagcggcggcacctatggcctggtggtgggtcatgtggctcctgaagctgctgttggtggaacgatcggcctggtgcaagaaggcgacagcatcacggttgatgctgatcagctgctgctccaactcaacgtggatcaagcggaactggatcgccgtcgtgcgggatggagcaagccggaaccgcgttaccgcagcggaattctcggcaagtacgcgcggctcgtctccagctcaagccggggtgcaaccaccgaccacgccgactga

SEQ ID NO: 258 - protein, 557 aa, Synechococcus sp.
MLRSDAVTKGIQRSPNRAMLRAVGFGDSDFGKPILGIANGYSTITPCNIGLNDLAKRAEEAARQAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQLTSGKIDEVQLTAVEKNACPGAGSCGGMFTANTMSAAIETMGLSLPYSSTMAAEDEEKADSAARSAEVLVEAVKANIRPLDLLTKEAFENAISVIMAVGGSTNAVLHLLAIARTAGVDLSIDDFERIRQRVPVICDLKPSGRYVTVDLHNAGGIPQVMKLLLDAGLLHSDCRTVEGKSLKELLADVPSEPPAGQEVIRPLSNPLYAKGHLAILKGNLASEGSVAKISGVKTPVLTGPARVFESEEDCLAAILDKKIQAGDVVVVRNEGPVGGPGMREMLAPTSAIVGQGLGDKVALITDGRFSGGTYGLVVGHVAPEAAVGGTIGLVQEGDSITVDADQLLLQLNVDQAELDRRRAGWSKPEPRYRSGILGKYARLVSSSSRGATTDHAD

SEQ ID NO: 259 - DNA, 1674 bp, Synechococcus sp.
atgcttcgttccgacgccgtcacaaaggggatccagcgttcccccaaccgcgccatgctccgtgcggtgggattcggagatgaggacttcggcaagccgattctcgggatcgccaacggctacagcacgatcacaccctgcaatgtcgggttgaacgacctgtcccggcgcgctgaagaggctgcccgtcaggccggcggcatgccacagatgttcggaaccatcacggtgagtgatggcatctccatgggcaccgaagggatgaagtactccctggtaagccgtgaggtgatcgccgatgcgattgaaaccgcctgcaatggccagagcatggatggcgtgctggcggtgggcggctgcgacaagaacatgcccggcgccatgttggccatggcgcggatgaacattccggctgtgttcgtttacggcggcacgatcaagccggggaaactcggcggctgtgatctcaccgtggtcagcgcctttgaggcagttggtcagctcaccagcggcaacatcgacgaagaccagctcaccgctgtcgaaaagaacgcttgcccaggagccggcagctgcggcggcatgttcaccgccaacacgatgagtgcagccatcgaaacgatggggttgagcctgccctacagctcaacgatggcggcagaagacgaagagaaggccgacaatgccgctcgttcagcagaggtgttgttggacgcggtgaaggccaacattcgacccttggatctgctcaccaacgatgcattcgagaacgccatcagcgtgatcatggcggtgggtggatccaccaacgccgtgctgcacctgctggcgatcgcccgtacggctggggtctccctcagcatcgacgacttcgagcggatccgtcagcgcgtgccggtgatctgtgacctcaagccgagcggccgctacgtgacggtggatctccacaacgctggcggtatcccccaggtgatgagactgctgctcgatgccgggctgctgcatggcgattgccgcaccgttgagggcaaaagcctgcgtgaggtgctggcggatgtgccctccgtgccaccggccgatcaagacgtgatccgtccactgagcaatcccctttacggcaaaggccacctggccatcctcaagggcaacctggccagtgagggcagtgtggccaagatcagcggcgtcaagacaccagtgctcaccggccccgcccgggtatttgagagcgaggaagactgcctcgccgccatcctggatcaacggatcaaggccggcgatgtggtggtggtgcgcaatgaggggcccgtgggaggtccgggcatgcgcgaaatgctggcccctacctccgccatcgtcgggcaaggcctgggagacagggtggctctgatcaccgatggccgcttcagcggcggcacctatggcctggtggtcggtcacgttgcccccgaagccgctgtcggcggaaccatcggcctggtgcagggaggcgacagcatcaccgtggatgccgaccagttgctgctgcaactcaacgtggatgaggcggaactcacgcgacgccgggcagcctggagcaagccggaaccccgttatcgcactgggattctgggcaagtacgcccgtctggtgtccagttcaagccgtggagcggtcaccgaccagcccgactga

SEQ ID NO: 260 - protein, 557 aa, Synechococcus sp.
MLRSDAVTKGIQRSPNRAMLRAVGFGDEDFGKPILGIANGYSTITPCNVGLNDLSRRAEEAARQAGGMPQMFGTITVSDGISMGTEGMKYSLVSREVIADAIETACNGQSMDGVLAVGGCDKNMPGAMLAMARMNIPAVFVYGGTIKPGKLGGCDLTVVSAFEAVGQLTSGNIDEDQLTAVEKNACPGAGSCGGMFTANTMSAAIETMGLSLPYSSTMAAEDEEKADNAARSAEVLLDAVKANIRPLDLLTNDAFENAISVIMAVGGSTNAVLHLLAIARTAGVSLSIDDFERIRQRVPVICDLKPSGRYVTVDLHNAGGIPQVMRLLLDAGLLHGDCRTVEGKSLREVLADVPSVPPADQDVIRPLSNPLYGKGHLAILKGNLASEGSVAKISGVKTPVLTGPARVFESEEDCLAAILDQRIKAGDVVVVRNEGPVGGPGMREMLAPTSAIVGQGLGDRVALITDGRFSGGTYGLVVGHVAPEAAVGGTIGLVQGGDSITVDADQLLLQLNVDEAELTRRRAAWSKPEPRYRTGILGKYARLVSSSSRGAVTDQPD

SEQ ID NO: 261 - DNA, 1674 bp, Synechococcus sp.
atgctcagatccgacgccgttaccaaagggattcagcgatcccccaaccgcgccatgctccgggccgttggttttggtgatgctgatttcggcaaaccgatcctgggaatcgccaacggctacagcacgattacgccctgcaatatcgggcttgatgttttagcgaaacgtgccgaagaagcggcccgtctggctggaggaatgccgcaaatgtttggcaccatcacggtgagtgatggaatctcgatggggactgaagggatgaaatattcccttgtcagccgagaagtcatcgccgatgccatcgaaacggcctgtaacggtcagagcatggatggagtcttggcagttggtggctgcgacaaaaatatgcctggtgcgatgttggccatggcacggatgaatatcccctccgtgtttgtttatgggggaacgatcaagccgggaaaactcggcggctgtgatctcactgtggtgagtgcctttgaagccgttggtcaaatcaccagcggcaaaatcgatgaagaacaactcacggcggtggaaaagaacgcctgtcctggtgcaggaagttgcggcggcatgtttaccgccaacacgatgagtgcagccatcgaaacgatggggttaagccttccttacagctccacgatggcggccgaagaccaggaaaaagcggacagcgcggctcgctcagcagaggtgttggtggatgccgtgaaagccaacatccggccgctcgatctgctcacaaaacaagccttcgaaaacgccatcagcgtgatcatggcggtcggcggttccaccaatgccgttttgcatttgctggcgattgctcgcacagctggggttgatttgagcattgacgactttgaacgcattcggcaacgcgtcccagtgatctgcgatctcaaacccagcggtcggtttgtcaccgttgatctgcacaacgctggaggaatccctcaagtgatgaagttgctgcttgatgccggattgctccacggcgattgccaaacagttgaagggaaaagtctcaacgcattgttggcggatgtgccatctgcaccccccgcagaccaagaggtgattcgacctctgagcaatccgatgtacagcaaaggacaccttgccatcctcaaaggaaatttggccctggagggcagtgtggccaagatcagcggcgtcaaaactcctgtactgacgggtccagctcgggtttttgaaagtgaggaagactgtctggcctccatccttgagaaaaggatcaatgcgggagacgtcgttgtgatccgctacgaaggtccggtcggtggacctggcatgcgggaaatgttggcgcccacctcagccatcgtcggccagggactcggcgacaaagtggcattaattaccgatggacgatttagcggtggtacctacggactcgtggtgggtcacgtcgctccagaagccgctgttggtggaacgattggccttgtgcaagagggagacagcatcaccgtggatgccaatcaactcttgcttcagctcaatgttgacgacacggaattagccaaacgacgagcagcatggtcgaaaccaaaacctcaatacaccactggaattttgggtaaatatgcccgactcgtttccacatccagcaaaggggctgtcaccgatcaaccggattaa

SEQ ID NO: 262 - protein, 557 aa, Synechococcus sp.
MLRSDAVTKGIQRSPNRAMLRAVGFGDADFGKPILGIANGYSTITPCNIGLDVLAKRAEEAARLAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQITSGKIDEEQLTAVEKNACPGAGSCGGMFTANTMSAAIETMGLSLPYSSTMAAEDQEKADSAARSAEVLVDAVKANIRPLDLLTKQAFENAISVIMAVGGSTNAVLHLLAIARTAGVDLSIDDFERIRQRVPVICDLKPSGRFVTVDLHNAGGIPQVMKLLLDAGLLHGDCQTVEGKSLNALLADVPSAPPADQEVIRPLSNPMYSKGHLAILKGNLALEGSVAKISGVKTPVLTGPARVFESEEDCLASILEKRINAGDVVVIRYEGPVGGPGMREMLAPTSAIVGQGLGDKVALITDGRFSGGTYGLVVGHVAPEAAVGGTIGLVQEGDSITVDANQLLLQLNVDDTELAKRRAAWSKPKPQYTTGILGKYARLVSTSSKGAVTDQPD

SEQ ID NO: 263 - DNA, 1677 bp, Synechococcus sp.
atggcccccctccgatccagcgccatcacgcaaggtgttcagcgcagtcccaaccgcgccatgttgcgcgctgttggtttcggagatggtgacttcagcaaaccgatcatcgggattgccaacggttacagcaccatcacgccctgcaatgtggggctcaacgatctagccctgcgcgccgaagcagccacacaagcagccggggggatgccgcaactcttcggcaccatcaccgtgagtgatggcatctccatgggcaccgaggggatgaagtactccctggtgagccgcgaagtgattgccgatgccatcgagaccgcctgcaacggtcaaagcatggatggcgtattggccatcggcggctgcgacaaaaacatgcccgccgccatgttggcgatggcgcggatgaacatcccaggtgtcttcgtctatggcggcaccatcaagcccggcaaattgggcggctgcgacctcaccgtggtcagcgcctttgaagcggttggtcagttgagcagcggcaagatcgatgaagcccagctcaccgctgttgaaaagaacgcttgcccaggagctggcagctgtggtggcatgttcacggccaacacgatgagtgcggccatcgaaacgatggggttgagcttgccgttcagctccaccatggcggcggaagatcccgagaaagccgagagcgctgctcgctcggctgaggtgttggtggaggccattgctgccaacattcgtccgttggatctgctgacccgcgaagcgtttgaaaacgccatcagcgtgatcatggccgtgggtggctccaccaatgcggtgttgcacttgctcgcgattgcacgcaccgccggcgtaccactgtcaatcgacgacttcgaaacgattcggcaacgggtgcctgtgatctgcgatctcaaaccaagcggacgctttgtaacggtcgacctgcacaacgctggtggcattccgcaagtcatgaaacttctgctcgatggtgggttgctccatggcgattgccgcaccgtggagggcaaaaccttgcgagaggttctggctgatgttccctcagaaccgccggctgatcaggaggtgatccggcccctgagcaatcccctctatgccaaagggcacctggctgtgttgaaaggcaacctcgccagtgaaggggctgtcgccaagatcagtggtgtcaaaacaccagtgctcacaggcccagccagggtgtttgaaagcgaagagcagtgcctgcaggcgatcttggcgaaccaggttcacgcaggtgatgtggtggtggtgcgcaatgaaggccccgttggtggcccgggaatgcgggagatgttggcgcccaccgccgccatcgttggtgaagggctcggcgacaaggtggcgttgatcaccgacggtcgcttcagcggcggcacctacggcctggtggttgggcatgtggccccagaagcagccgtaggcggcatgatcggcctggtgcaagagggcgattccatcaccgtggatgcccaacaacaattgctgcagctcaatgtggatgccgctgaattggagcggcgcaagcaagcgtgggtcaaaccagaaccgcgttaccgcaccggtgttttgggtaaatacgcccgtttggtgagcagcagcagcaagggcgctgtgactgatcaaccctga

SEQ ID NO: 264 - protein, 558 aa, Synechococcus sp.
MAPLRSSAITQGVQRSPNRAMLRAVGFGDGDFSKPIIGIANGYSTITPCNVGLNDLALRAEAATQAAGGMPQLFGTITVSDGISMGTEGMKYSLVSREVIADAIETACNGQSMDGVLAIGGCDKNMPAAMLAMARMNIPGVFVYGGTIKPGKLGGCDLTVVSAFEAVGQLSSGKIDEAQLTAVEKNACPGAGSCGGMFTANTMSAAIETMGLSLPFSSTMAAEDPEKAESAARSAEVLVEAIAANIRPLDLLTREAFENAISVIMAVGGSTNAVLHLLAIARTAGVPLSIDDFETIRQRVPVICDLKPSGRFVTVDLHNAGGIPQVMKLLLDGGLLHGDCRTVEGKTLREVLADVPSEPPADQEVIRPLSNPLYAKGHLAVLKGNLASEGAVAKISGVKTPVLTGPARVFESEEQCLQAILANQVHAGDVVVVRNEGPVGGPGMREMLAPTAAIVGEGLGDKVALITDGRFSGGTYGLVVGHVAPEAAVGGMIGLVQEGDSITVDAQQQLLQLNVDAAELERRKQAWVKPEPRYRTGVLGKYARLVSSSSKGAVTDQP

SEQ ID NO: 265 - DNA, 1671 bp, Synechococcus sp.
atgctccgctccgccgcgatcacccaggggattcagcgctctccgaatcgagccatgctccgtgctgtgggtttcggcgacggcgacttcaacaagccgatcatcggcatcgccaacggctacagcaccatcaccccctgcaatctggggctcaatgatcttgctcgacgcgccgaggaagccgcccatcaggtgggagcgatgccccagatgttcggcaccatcaccgtgagcgatgggatttcgatggggaccgaagggatgaaatattcccttgtgagccgggaggtgattgccgattcgatcgaaacggtcgtcaacgggcaaagcatggatgccctgctggcgatcggtggctgtgacaagaacatgcctggtgccatgctggcgatggcgaggatgaacgtcccctcgatcttcgtgtatggcggcaccatcaagcctggcaagctcggtgcctgtgacctcaccgtggtgagtgcctttgaggcggtgggccagttcagtggcggcaagatcgaggagcaggaactcacggcgatcgagaaaaacgcctgccctggggcgggcagctgcgggggcatgtttactgccaacaccatgagtgccgccttcgaggtgctggggctgagcttgccctacagctccacgatggcggccgaagaccccgagaaggccgatagcgccgcccgtagtgccgaggttttggccgacgccatcgaggcccagatcctcccgcgcgatctgatgacgcgcgaagccttcgaaaacgccatcagtgtgatcatggccgtgggtggctccaccaactccgtgctgcatctgctggctgtcgcccgcacggcgggggtggcgctgagcattgacgacttcgagcggatccggcagcgcgtgccggtgatctgtgatctcaagccaagtggccgcttcgtgacggtggatctgcaccgggctgggggcattccccaggtgatgaaactactgctcgatgcagggctcttgcacggcgactgccgcacgatcgaaggcaagacccttcacgaggtgctcgccgctgtgccgtcggtcccccccgccggccaggaggtgattcggcccctgagccatccgctgtatgccaaggggcacctggcgatcctcaaaggcaacctggccgaggaaggcgcggtggccaagatcagcggcgtcaaaaacccggtcatcaccggccctgcccgcgtgttcgagagcgaagaaacctgcctggccgccattctcgacaagcagatcaaccccggcgatgtggtggtcgtgcgcaatgaggggccggtgggcggtcctggcatgcgggagatgctcagccccacctccgcgatcgtgggccaggggctgctcgacaaggtggctctgatcaccgatggccgcttctcaggcggttcctacggcctggtgatcggccacgtggctccggaggccgccgtggggggcacaatcggcctggtgcaggaaggcgacagcatcaccgtggatgcgaatcagctgctgattcaactcaacgtggatgaatccgagctagctcaacgtcgcgccgcctggacccaacccgaaccccggtatcgcaccggcatcctcggcaaatacgcccgacaggtgagctccagcagtgtgggggcggtgaccgatcagccctga

SEQ ID NO: 266 - protein, 556 aa, Synechococcus sp.
MLRSAAITQGIQRSPNRAMLRAVGFGDGDFNKPIIGIANGYSTITPCNLGLNDLARRAEEAAHQVGAMPQMFGTITVSDGISMGTEGMKYSLVSREVIADSIETVVNGQSMDALLAIGGCDKNMPGAMLAMARMNVPSIFVYGGTIKPGKLGACDLTVVSAFEAVGQFSGGKIEEQELTAIEKNACPGAGSCGGMFTANTMSAAFEVLGLSLPYSSTMAAEDPEKADSAARSAEVLADAIEAQILPRDLMTREAFENAISVIMAVGGSTNSVLHLLAVARTAGVALSIDDFERIRQRVPVICDLKPSGRFVTVDLHRAGGIPQVMKLLLDAGLLHGDCRTIEGKTLHEVLAAVPSVPPAGQEVIRPLSHPLYAKGHLAILKGNLAEEGAVAKISGVKNPVITGPARVFESEETCLAAILDKQINPGDVVVVRNEGPVGGPGMREMLSPTSAIVGQGLLDKVALITDGRFSGGSYGLVIGHVAPEAAVGGTIGLVQEGDSITVDANQLLIQLNVDESELAQRRAAWTQPEPRYRTGILGKYARQVSSSSVGAVTDQP

SEQ ID NO: 267 - DNA, 1617 bp, Synechococcus sp.
atgttgcgggccgtgggcttcggcgacggtgacttcaacaagccgatcatcggcatcgccaatggctacagcacgatcacgccctgcaacatcggcctgaacgatctggcccgctgcgccgaggagtctgcccgtctggctggggccatgccacagatgttcggcacgatcaccgtcagcgacgggatctcgatgggcaccgaggggatgaagtattccctggtgagccgggaggtgatcgctgattcgatcgaaaccgcctgcaacgcccagagcatggatggcctgctggccatcggcggctgcgataagaacatgcccggcgccatgctggcgatggcgcgcatgaacatcccggcgatcttcgtgtacggcggcacgatcaaacccggccggctcggcccctgcgacctcaccgtggtgagtgccttcgaggctgttggtcagttctcgggcggtcgcatcgatgaggaggaactgctggcgatcgagaagaacgcctgccccggcgccggcagctgcggcggcatgttcaccgccaacacgatgagttcggcgttcgaagcgatgggcctgagcctgccgggcagctccaccatgacggccgaggatccggagaaggccgagagcgctgcccgctccgccgaggtgctggtgcgggccatcgaggcgaacatccgcccccgtgatctgatcacccgcgaggcgatcgagaacgccatcagcgtgatcatggcggtgggggggtccaccaattcggtgctgcacctgctggcgatcgcccgcaccgccgaggtgccgctcacgatcgacgatttcgagacgatccgtcagcgggtgccggtgatctgcgatctcaagcccagcggccgtttcgtgacggtggatctgcaccgggccggcggcattccccaggtgatgaagctgctgctggatgccggcctgctgcacggcgattgccgcaccatcgaaggcctcacgctcaagcaggtgctggcggaggtgcccagcgagccccccgccgatcaggacgtgatccggcccctctccaatccgctctatgccaagggtcacctggcgatcctcaagggcaacctggccgaggaaggggccgtcgccaagatcagtggcgtcaagaccccggtgatcacggggccggcccgggtgttcgagagtgaggagagcgccctggaggcgatcctcgccggtgaggtccatgccggtgatgtggtggtggtgcgctacgagggcccggtgggcgggcccggcatgcgtgagatgctctcgcccacggccgcgatcgtgggccagggcctgggggaatcggtggcgctgatcaccgacggtcgcttcagcgggggctcctacggcctggtggtgggccatgtggcccccgaggccgccgtgggcggcaccatcgccctggtgcaggagggcgacagcatcaccgttgatgcccatcagctgctcatccagctcaatgtggaaaccagcgagctggagcggcgccgggcggcctgggtcaggcccgaaccgcgctaccgcactggagtgctgggcaagtacgcccggctggtgagcagcagcagcctgggggcggtcaccgatcagggttga

SEQ ID NO: 268 - protein, 538 aa, Synechococcus sp.
MLRAVGFGDGDFNKPIIGIANGYSTITPCNIGLNDLARCAEESARLAGAMPQMFGTITVSDGISMGTEGMKYSLVSREVIADSIETACNAQSMDGLLAIGGCDKNMPGAMLAMARMNIPAIFVYGGTIKPGRLGPCDLTVVSAFEAVGQFSGGRIDEEELLAIEKNACPGAGSCGGMFTANTMSSAFEAMGLSLPGSSTMTAEDPEKAESAARSAEVLVRAIEANIRPRDLITREAIENAISVIMAVGGSTNSVLHLLAIARTAEVPLTIDDFETIRQRVPVICDLKPSGRFVTVDLHRAGGIPQVMKLLLDAGLLHGDCRTIEGLTLKQVLAEVPSEPPADQDVIRPLSNPLYAKGHLAILKGNLAEEGAVAKISGVKTPVITGPARVFESEESALEAILAGEVHAGDVVVVRYEGPVGGPGMREMLSPTAAIVGQGLGESVALITDGRFSGGSYGLVVGHVAPEAAVGGTIALVQEGDSITVDAHQLLIQLNVETSELERRRAAWVRPEPRYRTGVLGKYARLVSSSSLGAVTDQG

SEQ ID NO: 269 - DNA, 1671 bp, Prochlorococcus marinus
atgctcagatccgccgccatcacaaagggaactcaacgctctcccaaccgagccatgcttcgcgcagtgggctttggcgacgaagacttcaataaaccaatcatcggtatagccaacggctacagcacgatcactccttgcaacatcggtcttaatgacctggcgcgacgttcagaagaagcagcccgccaggccggtgcaatgccccagatgttcggcaccatcactgtcagtgatggcatctctatgggcaccgaagggatgaaatattccctggtaagtcgcgaggtgattgctgattcgatcgagacagcctgcaacgcccaaagcatggacggcgtactagcaatcggtggctgtgacaaaaacatgcctggagcgatgatcgccctggcccgaatgaacatcccaggtgtctttgtctatggcggaacgatcaaaccaggaaaattggctgaccgcgacctcactgtagtcagcgcctttgaagctgttggtcagcatgccagtggcaagataaatgaggagcaactcaccgctatcgagaagaacgcttgcccaggagcaggaagttgcggtggcatgtttacagccaacacgatgtcagccgctattgaaacattgggattgagtttgccttacagctcaacgatggctgcagaggatgaggaaaaagcaaatagcgcagcccgtagtgctgaagtgcttgtggatgccattaaggcaaatatctgtccccgcgatctactcaccaagaacgcatttgaaaacgcgattagcgttgtcatggcagtgggcggctccaccaatgcagttctgcatctgcttgcgattgcccgtagcgcaggcgtagacctttgcatcgatgacttcgagcgcatccgccagcgtgtaccggtgatttgtgatctaaaacccagcggccgttacgtgactgttgatttgcataacgcaggcggcattccccaagtgatgaaacagttgcttgatgcaggcttacttcatggagactgccgcaatgtggaaggtaaaaccttgagagaactgctcaaggatgtgccatccgagccttcagcagagcaagacgtcattcatcccctctcgaaaccggtctatgccaaggggcacctggcgatccttaaaggcaatctggccagcgaaggatgcgtggccaagataagcgggatcaaaaccccagtacttactggacctgcaagggtttttgaaagcgaggaggcctgccttgctgccattctcaacaacaaggtgaaggcgggagatgtcgtcgtcatacgtaacgaaggcccggttggcgggcctggaatgcgagagatgcttgctcctacatctgccatcgtcggtgaagaccttggcgacaaggtggccttaatcacagatggacgcttcagcggaggtacctatggtttggtggtgggccatgtggcaccggaagcagccgtaggcggcatgattggccttgtgcaggaaggcgacagcatcaccatcgatgccaatcaactgctgatccaactcaatgtcgagaaggatgaattggagcgtcgctccagcgcatgggaaaaaacacagccgcgttatcaaacaggagttctcggtaaatacgcccgaatggtgagtagcgccagcaatggtgctgtcaccgaccagccctga

SEQ ID NO: 270 - protein, 556 aa, Prochlorococcus marinus
MLRSAAITKGTQRSPNRAMLRAVGFGDEDFNKPIIGIANGYSTITPCNIGLNDLARRSEEAARQAGAMPQMFGTITVSDGISMGTEGMKYSLVSREVIADSIETACNAQSMDGVLAIGGCDKNMPGAMIALARMNIPGVFVYGGTIKPGKLADRDLTVVSAFEAVGQHASGKINEEQLTAIEKNACPGAGSCGGMFTANTMSAAIETLGLSLPYSSTMAAEDEEKANSAARSAEVLVDAIKANICPRDLLTKNAFENAISVVMAVGGSTNAVLHLLAIARSAGVDLCIDDFERIRQRVPVICDLKPSGRYVTVDLHNAGGIPQVMKQLLDAGLLHGDCRNVEGKTLRELLKDVPSEPSAEQDVIHPLSKPVYAKGHLAILKGNLASEGCVAKISGIKTPVLTGPARVFESEEACLAAILNNKVKAGDVVVIRNEGPVGGPGMREMLAPTSAIVGEDLGDKVALITDGRFSGGTYGLVVGHVAPEAAVGGMIGLVQEGDSITIDANQLLIQLNVEKDELERRSSAWEKTQPRYQTGVLGKYARMVSSASNGAVTDQP

SEQ ID NO: 271 - DNA, 1671 bp, Prochlorococcus marinus
atgcttagatcaaatgcaataacacagggtattcaacgatcaccaaaccgagcaatgcttagagctgttgggtttgatgataatgattttaacaagccaatcattggaatagctaatgggcacagcacaataaccccatgcaatatgggattaatggatttagctaatagagcagagtcagcgttaaaagaggctggtgcaatgcctcaaactttcggaaccataactgttagtgacggcatttccatgggaacggaagggatgaaatactcattagtttcaagagaagttattgcagattcaatcgagacggcttgcaatgctcaaagcatggatggggtgttagcgataggtggatgcgataaaaatatgccaggagcaatgttatcaatggcaagaatgaacataccttcgatttttgtttatggggggacaattaaacctgggaaattagacggttgcgacttgaccgtggtgagttcatttgaggctgtcggtcaattagcaagcggaaaaatcgacaaagatcgtttaatagctgtagaaaaaaatgctatccctggaccaggcagttgcggagggatgtttactgctaataccatgtctgcggcaatagaaacgatgggttttagtttgccatttagttcaacaatggctgcagtagatgatgaaaaagcagaaagcgctgctgaaagtgctcaggtccttgtaaatgcagtaaagaataacatcaggccattagatttacttacgaaagaagcctttgagaatgcaatcagtgtcatcatggctgtaggcggctcaacaaattctgtccttcacctacttgctatagctaggactgcaggagttgatttaacgatcgatgactttgaacgtataaggcagactgttcctgtgatttgcgacctcaaaccaagcggtaaatacgtaacagtcgacctacataaagctggtgggattcctcaagtaatgaaattactcctcgatgcaggaatgctacatggagaatgcaaaaccattgaaggaaaaacaattaaagaagttcttagagatatcccctcaaagcccaaagaaaatcaagacgttataagacaaatatcaaaccctatttataaaaaaggacatcttgctattctcaaaggaaatttagcaagtgaaggaagtgtcgcaaaaattagtggtgtaaagactcccgttttaaccgggcctgcaagggtctttgagagtgaagaagaatgcttaactgccattcttgacaataaagtaaaagctggagatgtagtcgtcgttaggtatgaaggacctgtaggagggcctgggatgagggagatgctctctccaacctcagcgattgtaggtcaaggtttaggagagaaagttgcactaattactgatggtcgatttagtggaggatcatatggattagtggttggccacgttgctccagaagcagccgtcggaggaacaattggattagtagaggaaggagacagtattaccgttgacgctaataaattgttaattcaattaaatgtcgaagagcgagaactagctagaagaaaacagaaatgggagaagccaaagcctagatataagacaggcattcttgggaagtattccagattagtaagttcatcaagccaaggagcgacaactgatcaaatataa

SEQ ID NO: 272 - protein, 556 aa, Prochlorococcus marinus
MLRSNAITQGIQRSPNRAMLRAVGFDDNDFNKPIIGIANGHSTITPCNMGLMDLANRAESALKEAGAMPQTFGTITVSDGISMGTEGMKYSLVSREVIADSIETACNAQSMDGVLAIGGCDKNMPGAMLSMARMNIPSIFVYGGTIKPGKLDGCDLTVVSSFEAVGQLASGKIDKDRLIAVEKNAIPGPGSCGGMFTANTMSAAIETMGFSLPFSSTMAAVDDEKAESAAESAQVLVNAVKNNIRPLDLLTKEAFENAISVIMAVGGSTNSVLHLLAIARTAGVDLTIDDFERIRQTVPVICDLKPSGKYVTVDLHKAGGIPQVMKLLLDAGMLHGECKTIEGKTIKEVLRDIPSKPKENQDVIRQISNPIYKKGHLAILKGNLASEGSVAKISGVKTPVLTGPARVFESEEECLTAILDNKVKAGDVVVVRYEGPVGGPGMREMLSPTSAIVGQGLGEKVALITDGRFSGGSYGLVVGHVAPEAAVGGTIGLVEEGDSITVDANKLLIQLNVEERELARRKQKWEKPKPRYKTGILGKYSRLVSSSSQGATTDQI

SEQ ID NO: 273 - DNA, 1674 bp, Prochlorococcus marinus
atgaataaacttagatcatctgctattacccaaggtgtgcaaaggtcacctaacagatcaatgttaagggcagttggttttaatgatgaagattttaacaaacctattattggggttgccaatggttacagcacaataaccccatgcaatatagggttaaataaattagctctcaaagctgaagagtcaattagacgatcagggggaatgcctcaaaaattcgggaccatcactgtaagtgatggcatttccatgggaacagaggggatgaaatattcattagtttcaagagaagtaatagctgactcgattgaaacagcatgtaatgctcaaagtatggatgcagtacttgctataggtggatgcgataaaaatatgcctggagcaatgatagcgattgcgaggatgaatattccctcaatatttatctatggaggaactataaaaccaggcaaattacatggggaagatcttacggttgttagtgcgttcgaagctgttggacagttaacatcaggcaaaattaatgagaaaaggttaatcgaagttgagaaaaattgtatccctggagctggaagctgtgggggaatgtttacggctaatacaatgtctgcagtaatagaagtgttaggtttaagccttccacacagttcaactatggctgctgaagatcttgaaaaagaactaagtgcagaaaaaagtgctgagatattagtatctgcgattaaaaaaaatataagaccattagacttaatgactaaaaaagcatttgaaaatgcaatatcagtaattatggccgtaggaggttcaacgaatgcagtattacatatattagcaatagcaaatactgcaggtattgatattaatattgatgactttgagaggataagacaaaaagttcctgtaatttgtgaccttaagccaagtggaaaatttgtaacagttgatcttcataatgcagggggaattccccaagttatgaaaatactcctaaatgcaggattaattcatggggaatgcaaaaacattgaaggcaaaactataactgaatacttacaaaacattccagataagcctcctagtaatcaaaatgtcatccgaggaatagattatcccctttataaaaaagggcatttagcaattttaaaagggaacctggcaaaggaaggttctgtagcaaaaattagtggagtaaaaaatccagttttaacaggtccagcaaagatattcgagagtgaagaagattgtcttaaagcaatcttaaataacgaaattatagctggtgatgttgttgttgtaagaaatgaaggtcctgtcggaggtccagggatgagagaaatgttatccccaacatcagcaattgttggacaaggacttggagaaaaagtggccttaattactgatggtaggtttagcggtggctcttatggtcttgttgtcgggcatatagcccctgaagcagctgtcggtggaaacattgctctaataaaagaaggtgatttgattacagttgatgctgtaaagcaactaattgaggttgatttatctgacgaagaattagaaaaaagaaaaaataattgggtaaaacctaaacctaaatataaaagaggaatactttcaaagtattcgaaaatagtaagtacatcaagtttaggggctgttactgatttatag

SEQ ID NO: 274 - protein, 557 aa, Prochlorococcus marinus
MNKLRSSAITQGVQRSPNRSMLRAVGFNDEDFNKPIIGVANGYSTITPCNIGLNKLALKAEESIRRSGGMPQKFGTITVSDGISMGTEGMKYSLVSREVIADSIETACNAQSMDAVLAIGGCDKNMPGAMIAIARMNIPSIFIYGGTIKPGKLHGEDLTVVSAFEAVGQLTSGKINEKRLIEVEKNCIPGAGSCGGMFTANTMSAVIEVLGLSLPHSSTMAAEDLEKELSAEKSAEILVSAIKKNIRPLDLMTKKAFENAISVIMAVGGSTNAVLHILAIANTAGIDINIDDFERIRQKVPVICDLKPSGKFVTVDLHNAGGIPQVMKILLNAGLIHGECKNIEGKTITEYLQNIPDKPPSNQNVIRGIDYPLYKKGHLAILKGNLAKEGSVAKISGVKNPVLTGPAKIFESEEDCLKAILNNEIIAGDVVVVRNEGPVGGPGMREMLSPTSAIVGQGLGEKVALITDGRFSGGSYGLVVGHIAPEAAVGGNIALIKEGDLITVDAVKQLIEVDLSDEELEKRKNNWVKPKPKYKRGILSKYSKIVSTSSLGAVTDL

SEQ ID NO: 275 - DNA, 1674 bp, Prochlorococcus marinus
atgaataaactcagatcatctgcaataacccaaggtgtgcaaagatcacctaacagatcgatgttaagagctgttggatttaatgatgaagattttaataaacctattattggagttgcaaatggatacagcaccataacaccatgcaatatgggtttaaataagttagctctaaaagctgaagagtctataaaaagatcaggtgggatgcctcagatgtttgggactataacagtaagtgatgggatttctatgggaacagagggcatgaaatattccctagtttcaagagaagttattgctgattcaattgaaacagcatgcaatgctcagagtatggatggagtacttgctataggtggatgtgataaaaatatgccgggtgccatgattgcgattgcaagaatgaatattccatcaattttcatttatggaggaacaataaagcctgggaaattgcatggagaagatcttactgttgttagtgcatttgaagctgttggacaattaacatcaggcaaaattaatgaagaaaggctaatccaagttgagaaaaattgtattcctggtgctggtagctgtggaggaatgtttacagctaatacaatgtctgcggttattgaagtattagggttaagtcttcctcacagttccactatggctgctgaagatcttgaaaaagaactaagtgcagacaaaagtgctgagatattagtctccgcaatagaaaaagatataagacctctagacctaatgactaagaaagcatttgaaaatgcaatatcagtaattatggcaattggcggatcaacaaatgcggtattgcacatcttagctatcgcgaatactgcaggaatagatatcaacattaatgattttgagagaatcagacaaaaagtacccgttatttgtgaccttaaaccgagtggtaaatatgtgacggtggatcttcataaggcaggtgggattccacaagtaatgaaaatacttttgaatgcaggattaattcatggcgattgcaaaaacattgaaggaaaaaccatctcagaatacttacaaaatattccagataagcctccaacaaatcaaaatgtcataagagacatagataaccctctttataaaaaaggacatctagcgatattaaaaggtaacttagcgagcgaaggttctgtagccaaaattagcggagtaaaaaaccctgtattaacaggtcccgcaaaaatttttgaaagtgaagaagattgtttaaaatcgatattaaataacgatatcaaagctggtgatgttgttgttattagaaacgaaggtcctgtaggaggaccaggtatgagagagatgttagctccaacatctgcaattgttggtcaagggctaggagagaaggtggctttaattaccgatggcagatttagcggcggtacctatggtcttgttgtgggtcacatagctccagaggctgctgtaggaggaaatattgctctaataaaacaaggtgatttaattacagtagatgctgtaaaacaactaattgaagttgatttatctgacgaagaattagaaaaaagaaaaaaagattgggtaaaacctattcaaaaatacaaaagaggaattctttcaaaatattcgagaatcgtaagcacatcaagtttaggggctgttactgatttataa

SEQ ID NO: 276 - protein, 557 aa, Prochlorococcus marinus
MNKLRSSAITQGVQRSPNRSMLRAVGFNDEDFNKPIIGVANGYSTITPCNMGLNKLALKAEESIKRSGGMPQMFGTITVSDGISMGTEGMKYSLVSREVIADSIETACNAQSMDGVLAIGGCDKNMPGAMIAIARMNIPSIFIYGGTIKPGKLHGEDLTVVSAFEAVGQLTSGKINEERLIQVEKNCIPGAGSCGGMFTANTMSAVIEVLGLSLPHSSTMAAEDLEKELSADKSAEILVSAIEKDIRPLDLMTKKAFENAISVIMAIGGSTNAVLHILAIANTAGIDININDFERIRQKVPVICDLKPSGKYVTVDLHKAGGIPQVMKILLNAGLIHGDCKNIEGKTISEYLQNIPDKPPTNQNVIRDIDNPLYKKGHLAILKGNLASEGSVAKISGVKNPVLTGPAKIFESEEDCLKSILNNDIKAGDVVVIRNEGPVGGPGMREMLAPTSAIVGQGLGEKVALITDGRFSGGTYGLVVGHIAPEAAVGGNIALIKQGDLITVDAVKQLIEVDLSDEELEKRKKDWVKPIQKYKRGILSKYSRIVSTSSLGAVTDL

SEQ ID NO: 277 - DNA, 1680 bp, Prochlorococcus marinus
atgaataaattaagatcttctgcaataactcaaggtgttcaaagatctcctaacagatcaatgttaagagcagttggatttagtgatgatgatttcactaaaccaatcattggagtcgctaatggatatagcaccattacaccctgcaatatgggccttaacaagttagctcttaaggcagaagattcaataaggaaatcaggaggaatgcctcaaatgttcggaactatcaccgtaagcgatgggatctccatgggaacagaaggaatgaaatattctttagtttcaagggaagtaatagccgattcaatagaaactgcctgtaatgcgcaaagtatggatggtgttttagctattggtggttgtgataaaaatatgccgggtgcaatgatagcaattgcaagaatgaatatcccttccatatttatttatggaggaacaataaaacctggaaagttaaacggtgaagacttaacggttgtcagtgcatttgaagctgttgggcaattaacctcgggtaaaataaatgagaagagattaaatgaagttgagaaaaattgtattccaggagcaggaagttgtggaggaatgttcacagctaatactatgtcagcagttatagaagtcttaggtttaagtcttcctcatagttcaacaatggcagccgaagattatgagaaggtggtaagtgctgaaaaaagcgctgaaatacttgtagatgcaataaaaaaagatataaggccactagatcttatgactaaagaatcttttgaaaatgcaatatctgtaattatggctattggaggttcgacaaatgcagtgcttcacatattagcgatagcgaatactgcaggtatagagatcaatattgatgattttgaaagaataagacaaaaagttcctgtgatttgtgatttgaaacctagcggcagatatgtcacagtagatcttcataatgcaggaggcattccacaagtaatgaaaatacttttaaatgcaggattaataaatggtgattgcaaaaatatcgaaggtaaaacaatatctgaatatttacttaatattccagataatcctcctgaaaatcaaaatgttattagaaacataaataatcctctttataaaaaaggtcatttagcaatattaaaaggtaatttagcttcggaaggttgtgtagcaaaaatcagcggagtaaagaatccagttttaaagggtcccgctcgaatttttgaaagtgaggaagattgtcttaaatcaattttgaataatgatattaaagctggtaatgttgtcgttataagaaatgaaggtcctgtgggaggaccgggaatgagagaaatgttagctccaacatctgcaattgttgggcaagggctgggagaaaaagtagctttaataactgatggtagatttagtggaggtacctatggccttgttgttggacatatcgcaccagaggcagcagtaggagggaatatagctttaataagagagggagatttaatcactgttgatgctgtaaaccaattaattgaagttgaactatctgatggggaattagaaaaaagacgaattaactggataaagcctattccgaaatataagaaaggtgtactttcaaaatattcaagaattgtaagtacttcaagcttaggtgcagttacagatctggaaaaataa

SEQ ID NO: 278 - protein, 559 aa, Prochlorococcus marinus
MNKLRSSAITQGVQRSPNRSMLRAVGFSDDDFTKPIIGVANGYSTITPCNMGLNKLALKAEDSIRKSGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLNEVEKNCIPGAGSCGGMFTANTMSAVIEVLGLSLPHSSTMAAEDYEKVVSAEKSAEILVDAIKKDIRPLDLMTKESFENAISVIMAIGGSTNAVLHILAIANTAGIEINIDDFERIRQKVPVICDLKPSGRYVTVDLHNAGGIPQVMKILLNAGLINGDCKNIEGKTISEYLLNIPDNPPENQNVIRNINNPLYKKGHLAILKGNLASEGCVAKISGVKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIREGDLITVDAVNQLIEVELSDGELEKRRINWIKPIPKYKKGVLSKYSRIVSTSSLGAVTDLEK

SEQ ID NO: 279 - DNA, 1680 bp, Prochlorococcus marinus
atgaataaattaagatcatctgcaataactcaaggtgtccaaagatctcctaacagatcaatgttaagagctgttggttttagtgatgaagattttactaaacctataattggagttgctaacggatttagtactatcacaccatgcaatatgggtctaaacaagttagctctaaaagctgaagaatcaataagagaagcaggaggtatgcctcagatgttcggaaccatcaccgtaagtgatggaatctctatgggaacagagggaatgaaatattccctagtttcaagagaggttatagctgattcaatcgaaacagcatgcaatgcgcaaagtatggatggggttttagctattggaggttgtgataaaaatatgccaggagcaatgattgcaattgcaagaatgaatatcccatccatatttatttatggaggaacaataaaacctggtaaattaaatggtgaagatcttacagttgtcagtgcatttgaagctgttgggcaattaacttctgggaaaataaatgagaagagattaattgaagttgaaaaaaattgtatcccaggagctggaagttgtggaggaatgtttacagctaacactatgtctgctgttatagaagtcttgggtttaagtcttccatatagttcaacaatggcagctgaagattacgaaaaggaagttagcgctgaaaaaagtgctgaaatattagttgatgcaattagaaaagatattagacctttaactctcatgactaaagaatcatttgagaatgcaataactgtcattatggctattggaggttcaactaatgccgttctccatatattagcaatagcaaatacagcaggtatagatatcaatattgatgatttcgaaagaataagacaaaaagtacctgtaatttgcgacttaaaacccagcggtaaatacgtaacagtcgatcttcataaagcaggtggaattccacaagttatgaaaatacttctaaacacaggtttgatacatggtaattgtagaaacatagagggtaaaacagtagttgaatccttaaaagatattccagttaaacctccagagaatcaggatgtcattcgagatattgataatccactttataaaaaaggtcacttagcgattctaaaagggaacttagcctcggaaggttgtgtagccaaaattagtggaataaagaatcctgtattaaaaggacctgctcgcatctttgagagtgaggaggattgtctcaaatcaattttgaataatgatattaaagctggtaatgttgttgttataagaaatgaaggtcctgtgggcggaccagggatgagagaaatgttggcaccaacatccgcaattgttgggcaaggacttggagaaaaagtagcgctaataactgatggtagatttagtggaggcacctatggcctagttgttggccacattgcaccagaggcagcagttggaggaaatatagcgttaataaaagaaggcgatttaataactgttgatgctacaaaccaattaatcgaagttgaactatctgatgaggaattagaaatgagaagaattaactgggaaaagcctagtaaaaaatataaaaaaggagttctttctaaatattcaagaattgttagcacctcaagcctaggagccgttacagatttggaagaataa

SEQ ID NO: 280 - protein, 559 aa, Prochlorococcus marinus
MNKLRSSAITQGVQRSPNRSMLRAVGFSDEDFTKPIIGVANGFSTITPCNMGLNKLALKAEESIREAGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLIEVEKNCIPGAGSCGGMFTANTMSAVIEVLGLSLPYSSTMAAEDYEKEVSAEKSAEILVDAIRKDIRPLTLMTKESFENAITVIMAIGGSTNAVLHILAIANTAGIDINIDDFERIRQKVPVICDLKPSGKYVTVDLHKAGGIPQVMKILLNTGLIHGNCRNIEGKTVVESLKDIPVKPPENQDVIRDIDNPLYKKGHLAILKGNLASEGCVAKISGIKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIKEGDLITVDATNQLIEVELSDEELEMRRINWEKPSKKYKKGVLSKYSRIVSTSSLGAVTDLEE

SEQ ID NO: 281 - DNA, 1671 bp, Prochlorococcus marinus
atgcttcgatccagtgcaatcacccaaggaattcagagatcaccaaatagggctatgctccgagcggttggatttaatgataatgattttaacaagccaataattggtattgctaatgggtacagcacaattacaccatgcaatgttggattaaataacctagccctacacgcagaagcctcaacaaaagtatcaggcgctatgccacaaatgtttggcacaataactgttagcgatggaatatctatggggaccgaagggatgaaatattcactagtttcaagagaggttatagccgattcaatagagacagcatgtaatgctcaaagcatggacggtgttcttgcaataggaggatgtgataaaaatatgcctggagccatgattgccatggcaagaatgaatatacccgcaattttcgtgtatggagggacaattaaaccagggaaattagacggttgtgatttaacagtagtaagtgcatttgaagccgttgggcaattaacaagtggaaagattactgaagataaacttattgctgtagaaaagaattgtattcctggagcaggaagttgtggaggaatgttcacagctaataccatgtccgcagcaatagaaacgctcggattaagcttgccttatagctcaacaatggctgctgaagataaggaaaaaatagagagtgctgagcgtagtgccaaagtcctggtagatgcaattgaaaaaaatatacgtcctttagacctcctaaccaagaaatcatttgaaaatgctattgccgtagtcatggctgttggcgggtcgacaaatgccgtattacatttattagctattgctaggtcatcaggagtggacttatgcatagatgattttgaaagaattcgacagaaggtacctgtgatttgtgatttaaagccaagtggcaaatatgtcactgtagatctacataaagctggtggaatacctcaggtaatgaagctgcttttagatgcgggcttattacatggtgattgtttaactattgaaggtataactatcgatgagtccttaaaaaatatcccttcagagccaccagcgaaccaaaatgtgatatctccaatcacaaagccaatatataaaaaaggacatctagcaatcttaaaaggaaatctcgcaaccgaaggatgcgtagccaaaataagtgggattaggaccccagtgttgaaaggtccagcaaaagtatttgaaagtgaagaagactgtctcgacgcaatcttaaaagaacagatacaagaaggagatgtaatagttattagaaacgaaggccctgtaggaggacccggaatgagagaaatgttagcaccaacctctgccatagttggacaaggcctaggggataaggttgctctaataacagatggacgttttagcggtggtacttatggtttggtagtgggacatatagcaccagaagcatcagtgggagggaatatagccctagtcaaagaaggtgacatgattactgttgacgcgcacaaaaagttgattcaattggaagtagatgaaaaggagctctcaaaaaggaggactttatgggaaaaaccagaagttaaatataagactggaatactaggtaaatatgcgcgtttagttagcagttcaagcaagggtgctgtaactgatcaaccatga

SEQ ID NO: 282 - protein, 556 aa, Prochlorococcus marinus
MLRSSAITQGIQRSPNRAMLRAVGFNDNDFNKPIIGIANGYSTITPCNVGLNNLALHAEASTKVSGAMPQMFGTITVSDGISMGTEGMKYSLVSREVIADSIETACNAQSMDGVLAIGGCDKNMPGAMIAMARMNIPAIFVYGGTIKPGKLDGCDLTVVSAFEAVGQLTSGKITEDKLIAVEKNCIPGAGSCGGMFTANTMSAAIETLGLSLPYSSTMAAEDKEKIESAERSAKVLVDAIEKNIRPLDLLTKKSFENAIAVVMAVGGSTNAVLHLLAIARSSGVDLCIDDFERIRQKVPVICDLKPSGKYVTVDLHKAGGIPQVMKLLLDAGLLHGDCLTIEGITIDESLKNIPSEPPANQNVISPITKPIYKKGHLAILKGNLATEGCVAKISGIRTPVLKGPAKVFESEEDCLDAILKEQIQEGDVIVIRNEGPVGGPGMREMLAPTSAIVGQGLGDKVALITDGRFSGGTYGLVVGHIAPEASVGGNIALVKEGDMITVDAHKKLIQLEVDEKELSKRRTLWEKPEVKYKTGILGKYARLVSSSSKGAVTDQP

SEQ ID NO: 283 - DNA, 1677 bp, Prochlorococcus marinus
atgaagcttagatcaagcgcaataactcaaggcgtacagagatcgccaaacagagcaatgcttcgtgctgttgggtttgaagacgatgatttcaacaaaccaataataggtattgcaaatgggtatagcactatcacgccttgtaatattgggctaaatgatttggcaaaacaagcagaaaaagcaataaaggattgggatggtatgcctcaaatgtttggaacaattactgttagtgatggaatatctatggggactgaagggatgaaatactccttggtctctagagaagtaatagccgattcaatagaaactgcatgcaatgctcaaagcatggatggagtgttagcaataggtggttgcgataaaaacatgcctggtgcaatgctagccatggcaagaatgaatattccagggatatttgtttatgggggaacgatcaaaccaggaaaattaaatggcgaggatttgacagttgtaagtgcatttgaagctgtggggcaattaactagtgggaaaataacaaaagaaaaattgattgaggttgaaaaacattgcattccaggggctggtagttgtggaggtatgtttacagcaaacacaatgtcagcagccattgaagctatgggactaagtcttcctcacagttcaaccatggctgctgaggatcaagaaaaaataaaaagtactcaaaaaagtgccgaggttcttattaaagctatcaaggaaaatattcgcccattagatttattaaccaagcaagcattcgagaatgcaataagtgtagtaatggcagttgggggctctacaaatgctgtgcttcatcttttagcaattgctcattcatcgggagttgaactttctcttgacgaatttgaaaagatacgtcaacgagttccggtactttgtgatttaaagcccagtggtaaatatgtgactgttgacctacacaaagcaggaggcattccacaagtcatgaaaatacttcttgaagcaggattgattaatgaaaattgtagaacaatagaaaacaaaacaatcaaggaaatgctgctcgatgttcccgcagagcccccatcagatcaggatgttattcggcctttcgattcgccggtctataaaaaaggtcatttagcaattctcaaaggaaatcttgcaactgagggaagcgttgcaaaaatcagtggtataaaagaaccaatccttacaggtccagcaaaagtatttgaaagtgaagaagattgcttaaaagcaatacttactgaacaaattcactcaggtgatgtagtagtcataagaaatgaaggcccagttggtgggccagggatgagagaaatgctcgctccaacatctgcaattgttggtcaaggtcttggtgaaaaagttgctttaattactgacggacgttttagtggcggaacatatggactagtagttggtcatgtcgcaccagaagcagccgttggagggaatattgctctaattcaagatggtgacagcataactgttgatgctattcaaaaactcattcaagtaaatatcgaagaagcagaattaaaaagacgacgttcactttgggttaagccaaagcccaaatacaattcaggagttcttgggaaatatgcaactttggttagtagttcaagcaaaggtgctgtaactgatcagaactgttaa

SEQ ID NO: 284 - protein, 558 aa, Prochlorococcus marinus
MKLRSSAITQGVQRSPNRAMLRAVGFEDDDFNKPIIGIANGYSTITPCNIGLNDLAKQAEKAIKDWDGMPQMFGTITVSDGISMGTEGMKYSLVSREVIADSIETACNAQSMDGVLAIGGCDKNMPGAMLAMARMNIPGIFVYGGTIKPGKLNGEDLTVVSAFEAVGQLTSGKITKEKLIEVEKHCIPGAGSCGGMFTANTMSAAIEAMGLSLPHSSTMAAEDQEKIKSTQKSAEVLIKAIKENIRPLDLLTKQAFENAISVVMAVGGSTNAVLHLLAIAHSSGVELSLDEFEKIRQRVPVLCDLKPSGKYVTVDLHKAGGIPQVMKILLEAGLINENCRTIENKTIKEMLLDVPAEPPSDQDVIRPFDSPVYKKGHLAILKGNLATEGSVAKISGIKEPILTGPAKVFESEEDCLKAILTEQIHSGDVVVIRNEGPVGGPGMREMLAPTSAIVGQGLGEKVALITDGRFSGGTYGLVVGHVAPEAAVGGNIALIQDGDSITVDAIQKLIQVNIEEAELKRRRSLWVKPKPKYNSGVLGKYATLVSSSSKGAVTDQNC

SEQ ID NO: 285 - DNA, 1707 bp, Nodularia spumigena
atggaaggaaaaaaaatgtcggagaatttaagaagccaagttgttacccaaggagtgcagcgatcgcctaatcgagctatgctgcgtgcagtgggttttaaggacgaagattttaataaagccattgtcggcattgctaatggctacagtacaatcactccctgcaatatgggaattaataaactagcactaagagccgaaattggcgtaagagaagctggggcaatgccgcaaatgttcggtactatcaccattagtgatgggatttctatgggaaccgaggggatgaaatattccctagtgtcacgagaagttattgctgattccattgaaaccgcctgtactggacaaagtatggatggcgttttggctattggtggctgtgataaaaatatgccaggggcaatgctagcgatggcgcgcatgaatattcctgctatttttgtttatggtggcacaattaaacccggtcactacgatggtaaagatttaaccgtcgtgagttcctttgaagcagttggtcaatacagcgccggtaaaattgatggtgatgaactcttagcagtggaacgtgaagcttgtcctggtgctggttcctgcggtgggatgtttacagcaaataccatgtcttccgcttttgaagcaatgggcatgagcttaccttattcttccacaatggcagccgaagatgctgaaaaagccgacagtacgcaaaaatcagcagttgctttagtagaagccatacgtaagcaaatcttacctcggcagattatcacccgtaaatctatagaaaatgccatttcagtaattatggcagtgggtggttccacaaatgcagtattgcactttttagcgatcgctcgtgcagctggagtagaactcacactagatgattttgaaaccatccgtggacgtgtcccagttatctgtgatttaaaacccagtggtaaatatgtcgccacagacctgcacaaagctggcggaatacctcaagtcatgaaaatgttacttgtgcatgatttactccacggcgactgcttaactatcacaggtaaaacagtagcagaagtcttagcagatatctccgcagaaccacgtaccgaccaagatgtgattcgtccttggaataaccccatgtatgctcaaggacacttagccatcctcaaaggcaacctagccacagaaggggctgtagccaaaatcaccggagttaaaaagccgattattactggccctgcacgggtatttgagtctgaggaatcctgtttagatgccatcctcgcaaataaaattaatgccggggatgttctcataattcgttacgaaggtcccaagggtggccctggtatgagagaaatgcttgctcccacctcagcaattattggggctgggttaggcgatgcagtaggtttaattactgatgggcgcttttccggcggtacttacggcatggtagttggtcacgtagccccagaagcagccgttggtggtgcgatcgctcttgtagaagaaggtgatagcattaccattgatgcctctaatcgcctcttgcaattgaacgtctcagatgaagaattagcccgtagacgtgccaattggcaaccccttccaccccgttacaccaaaggcgtacttgctaaatatgccaaattagtatcttctagcagtgttggagcagtcacagatttagacttatttaatggttag

SEQ ID NO: 286 - protein, 568 aa, Nodularia spumigena
MEGKKMSENLRSQVVTQGVQRSPNRAMLRAVGFKDEDFNKAIVGIANGYSTITPCNMGINKLALRAEIGVREAGAMPQMFGTITISDGISMGTEGMKYSLVSREVIADSIETACTGQSMDGVLAIGGCDKNMPGAMLAMARMNIPAIFVYGGTIKPGHYDGKDLTVVSSFEAVGQYSAGKIDGDELLAVEREACPGAGSCGGMFTANTMSSAFEAMGMSLPYSSTMAAEDAEKADSTQKSAVALVEAIRKQILPRQIITRKSIENAISVIMAVGGSTNAVLHFLAIARAAGVELTLDDFETIRGRVPVICDLKPSGKYVATDLHKAGGIPQVMKMLLVHDLLHGDCLTITGKTVAEVLADISAEPRTDQDVIRPWNNPMYAQGHLAILKGNLATEGAVAKITGVKKPIITGPARVFESEESCLDAILANKINAGDVLIIRYEGPKGGPGMREMLAPTSAIIGAGLGDAVGLITDGRFSGGTYGMVVGHVAPEAAVGGAIALVEEGDSITIDASNRLLQLNVSDEELARRRANWQPLPPRYTKGVLAKYAKLVSSSSVGAVTDLDLFNG

SEQ ID NO: 287 - DNA, 1701 bp, Nostoc punctiforme
atgtcggagaatttgagaagccaagtagtgacgcaaggagtgcagcgatcgccaaatcgagctatgctgcgggcagttggttttaaagatgaagatttcaataaagccattgtcggtatagccaacggttacagcacgatcaccccctgcaatatggggataaatcaactggcacagagggcagaagctgggattaaaaccgccggagcaatgccgcaaatatttggcacaattaccatcagcgacgggatttcaatgggaaccgaagggatgaaatattccctagtatcgcgggaagttatcgccgattccatcgaaaccgcctgtaccggacaaagtatggatggtgtactagccattggtggctgtgataagaatatgccaggcgcaatgctagcgatcgcgcggatgaatatcccggcaatattcgtttacggtggcacaattaaacccggtcactacaacggacgcgatttaaccgttgtcagttcttttgaagctgttggtcaatacagtgcgggaaaaattgacgacaaggaattattagaagtcgaaagtcgcgcttgtcctggcgctggttcctgcgggggaatgttcacagctaacaccatgtcttcagcatttgaagcgatgggaatgagtttaccctattcttccacaatggcagccgaagatgccgaaaaagccgacagcacggaaaaatcagcctttgtgctagtcgaagccatcaagaagcaaatcttaccccggcaaattatcacccgtaaatctatagagaatgccatctctgtgattatggcggtgggtggttcgaccaatgcagtattgcatttcttagcgatcgcccgcgctgcgaatgtagagttaaccctagatgactttgaaacaatccgcgcccgtgttcccgttttgtgcgatctaaaaccaagcggtaaatatgtcgctacagatttgcacaaagctggtggcattccgcaagtcatgaagatgctactcgcacatggcttattgcatggtgatagtctcaccattagcggtcaaaccattgcagagatattagcagacatacccgaagagccatctgccaatcaagatgtgattcgggcttggaataacccgatgtatgctcaaggacatttagccatcctcagaggtaatctggcaacggaaggggctgtcgctaaaattaccggcgtgaaaaaaccagtcattaccgggcctgcacgggtgtttgagtcggaagaagcctctttagatgcaattttggcgggtaaaattcaagctggtgatattttggttattcgctacgaagggcccaaaggcggccctggaatgcgagaaatgttggctcccacttcggcaattatcggggctggcttgggtgatgcggtgggattaattaccgatgggcgcttttctggcggtacttatggcatggtggttggtcatgttgctccagaagcagcagtgggtggtgcgatcgcgcttgttgaagaaggcgatagtattaccattgatgcacccgcacgccttttgcagttgaatatatctgaagaagaattagctcgtcgtcgtgctaattggcaacctcccgctccacgttacaccaaaggcgtgttggcgaaatatgccaaactggtatcttctagcagcatcggtgctgtgacagatttggatttgttcaaaccacaacagaactaa

SEQ ID NO: 288 - protein, 566 aa, Nostoc punctiforme
MSENLRSQVVTQGVQRSPNRAMLRAVGFKDEDFNKAIVGIANGYSTITPCNMGINQLAQRAEAGIKTAGAMPQIFGTITISDGISMGTEGMKYSLVSREVIADSIETACTGQSMDGVLAIGGCDKNMPGAMLAIARMNIPAIFVYGGTIKPGHYNGRDLTVVSSFEAVGQYSAGKIDDKELLEVESRACPGAGSCGGMFTANTMSSAFEAMGMSLPYSSTMAAEDAEKADSTEKSAFVLVEAIKKQILPRQIITRKSIENAISVIMAVGGSTNAVLHFLAIARAANVELTLDDFETIRARVPVLCDLKPSGKYVATDLHKAGGIPQVMKMLLAHGLLHGDSLTISGQTIAEILADIPEEPSANQDVIRAWNNPMYAQGHLAILRGNLATEGAVAKITGVKKPVITGPARVFESEEASLDAILAGKIQAGDILVIRYEGPKGGPGMREMLAPTSAIIGAGLGDAVGLITDGRFSGGTYGMVVGHVAPEAAVGGAIALVEEGDSITIDAPARLLQLNISEEELARRRANWQPPAPRYTKGVLAKYAKLVSSSSIGAVTDLDLFKPQQN

SEQ ID NO: 289 - DNA, 1692 bp, Nostoc sp.
atgtcggagaattttagaagcaaggctatcacacaaggggtacagcgatcgcctaacagagcaatgctgcgggctgttggttttcaggatgcagattttaccaaagccattgtaggtgttgccaatggttacagcacgattaccccgtgtaatatggggataaatcaactagcacaaagggcagaagctggtataaatactgctggagcaaagccgcaaatattcggtacaattacgattagtgatgggatttcgatgggaaccgaagggatgaaatattccctggtatcacgagaagtaatcgctgactccattgaaaccgtttgtaatgggcaaagtttagacggggtaattgccattggtggctgtgataagaatatgccaggggcaatgattgcgatcgcccggataaatatccctgctatctttgtttacggtggcacaattaaacccggacattacaacggtaaagatttaactgttgtcagttcttttgaggctgttggtgagtacagcgccggtaaaattgacgaaaatgaactgttagcagtagaacgcaatgcttgtcctggtgcaggttcctgcggtgggatgtacacagcaaataccatgtcctctgcttttgaagcactggggatgagtttgccctattcgtctacaatggcggcagaagatgacgaaaaagctgatagtacggaagaatcagccaaggtattggtagaggcgattcgtcatcaattattacccagacagattatcactcgtaagtccatagaaaacgccatatctgtaattatggctgtgggtggttctactaatgcggtgttacattttctagcgatcgcccgtgcggctggtgtagaactaaatctggacgactttgaaactattcgtggtcgtgtccccgttttgtgcgacttgaaaccaagcggtagatatgtggctacagacctgcacaaagctggtggtataccccaagtcatgaaaatgttactcgtgcatggtttactccacggcgactgtatgaccatcacaggtaaaaccattgccgaagttttagcagatatcccagaagaaccatcgcctaatcaagatgtaattcgtccttggaataaccccatgtatgcccaaggccacttggctatactcaaaggtaatttggcaacagaaggcgcagttgccaaaattactggtgtgaaaaatcctgtgattacagggccagccaaagtatttgaatcagaagaggattgtttagatgcaattttggcaggtaaaattaaagccggtgacgtgattgtcatccgctacgaaggccccaaaggcggccctgggatgcgagaaatgttagcccccacctcagctattatcggtgcaggtttaggcgactcagtgggactaattaccgatggacgcttctccggtggtacttacggtatggttgtgggacacgttgcaccagaagcagccgttggtggggcgatcgctctggtacaagaaggtgatagcatcacaattgatgcccacgcccgttctttgcagttgaacatatcagacgaagaattaacccgtcgtcgtgccaattggcaaccccgtcccccacgttacactacaggcatactggcaaaatacgccaagttggtagcttctagtagtgtgggtgctgtcaccgatttagacttattcaataaatag

SEQ ID NO: 290 - protein, 563 aa, Nostoc sp.
MSENFRSKAITQGVQRSPNRAMLRAVGFQDADFTKAIVGVANGYSTITPCNMGINQLAQRAEAGINTAGAKPQIFGTITISDGISMGTEGMKYSLVSREVIADSIETVCNGQSLDGVIAIGGCDKNMPGAMIAIARINIPAIFVYGGTIKPGHYNGKDLTVVSSFEAVGEYSAGKIDENELLAVERNACPGAGSCGGMYTANTMSSAFEALGMSLPYSSTMAAEDDEKADSTEESAKVLVEAIRHQLLPRQIITRKSIENAISVIMAVGGSTNAVLHFLAIARAAGVELNLDDFETIRGRVPVLCDLKPSGRYVATDLHKAGGIPQVMKMLLVHGLLHGDCMTITGKTIAEVLADIPEEPSPNQDVIRPWNNPMYAQGHLAILKGNLATEGAVAKITGVKNPVITGPAKVFESEEDCLDAILAGKIKAGDVIVIRYEGPKGGPGMREMLAPTSAIIGAGLGDSVGLITDGRFSGGTYGMVVGHVAPEAAVGGAIALVQEGDSITIDAHARSLQLNISDEELTRRRANWQPRPPRYTTGILAKYAKLVASSSVGAVTDLDLFNK

SEQ ID NO: 291 - DNA, 1686 bp, Trichodesmium erythraeum
atgccagagaatttgagaagtcaattagtcaccaaaggagtacaacgcgctcccaaccgagctatgctgagagctgtgggttttgaagattcagactttaccaaaccaattattggggttgccaatgcccatagcactattactccctgcaacatgggtattaatgatttggccatgagagctgtaagtggagtgaaagaagctggaggaatgccgcagatatttggaactattactattagcgatggaatttctatgggtactgaggggatgaaatattctctggtttctagagacgttattgctgattccatcgaaacagtttgtaatggccaaacaatggatggagttctagctattggtggatgcgataaaaatatgccaggagcaatgatagcgatcgctaggatgaatattcctgctatcttcgtatacggtggtactattaaaccaggcaactacaacggtaaagacctaacagttgtaagtgcttttgaagcagtgggagaatatagtgctggaaaaattgacgaaacagaattaacagaagttgaacgtagagcttgccctggtgctggttcctgtggaggaatgtttactgccaatactatgtcttcagcttttgaagcaatgggtatgagtctcatgtattcatcaacaatggctgcagaagatgcagaaaaagcagatagcacagaaaaatcagctcatgttttagtagaagctattcgcaaacaaattttacctagtcaaattattacccgtaaagctatcgaaaatgcaatttcagtaattatggctgtagggggttccactaatgcagtactacacctattagcaattgcttatgctgcaaatgtgaagttatctttagatgattttgaaataattagggccagagtacctgtattatgtgatttgaaacctagtggtaaatacgttacaacaaatttgcatcaagcgggtggaattcctttagtaatgaaaatgcttttagaacatgatttactccacccagatgctttaaccataacaggtaagactattggagagcaattaacaaatataccttctgaaccaccttctaatcaagacgtgattcgcccttggaataatcctatgtatgctcaaggacacttggctattttaaaaggaaatttggcgacagagggagcagttgctaaaattacaggagtgaagaacccagaaataacaggactagcaagagtatttgattcggaagaagcttgtttagaagcaatattagcagggaaaattcaagcagggaatattattgtagttcgctatgaaggtccaaaaggtggaccaggtatgcgagaaatgttagcaccaacttcggctattattggtgctggtttgggggataaagtgggattaattactgatggtaggttttctggtggtacttatggtatggtggttggtcatgtagctccagaagctgcagtaggtggcacgatcgctctagttaaggaaggagatatgattactattgatgctcataagcgtttactacagttaaatatttctgatgaggaattagaaaagcgtcgtcaagtatggaaaccacgaaaaccccaatatactagaggtgtattagctaaatatgctaagttagtttcttctagcagtgttggagcagtaactgacgctggattaggttga

SEQ ID NO: 292 - protein, 561 aa, Trichodesmium erythraeum
MPENLRSQLVTKGVQRAPNRAMLRAVGFEDSDFTKPIIGVANAHSTITPCNMGINDLAMRAVSGVKEAGGMPQIFGTITISDGISMGTEGMKYSLVSRDVIADSIETVCNGQTMDGVLAIGGCDKNMPGAMIAIARMNIPAIFVYGGTIKPGNYNGKDLTVVSAFEAVGEYSAGKIDETELTEVERRACPGAGSCGGMFTANTMSSAFEAMGMSLMYSSTMAAEDAEKADSTEKSAHVLVEAIRKQILPSQIITRKAIENAISVIMAVGGSTNAVLHLLAIAYAANVKLSLDDFEIIRARVPVLCDLKPSGKYVTTNLHQAGGIPLVMKMLLEHDLLHPDALTITGKTIGEQLTNIPSEPPSNQDVIRPWNNPMYAQGHLAILKGNLATEGAVAKITGVKNPEITGLARVFDSEEACLEAILAGKIQAGNIIVVRYEGPKGGPGMREMLAPTSAIIGAGLGDKVGLITDGRFSGGTYGMVVGHVAPEAAVGGTIALVKEGDMITIDAHKRLLQLNISDEELEKRRQVWKPRKPQYTRGVLAKYAKLVSSSSVGAVTDAGLG

SEQ ID NO: 293 - DNA, 1686 bp, Acaryochloris marin
atgtctgacaatcgaaatagccaagtcgtcactcaaggagttcaacgagcccccaaccgggccatgctaagggctgtgggctttggagatgatgattttaccaagccgattgttgggttagcgaatggttttagtacgattaccccttgtaatatgggcatagactctctggctacacgggcagaggccagtatcagaacggctggagccatgccgcaaaagtttggcaccatcactatcagtgacggcatttccatgggcacggaagggatgaaatattccttggtgtcccgggaagtgattgcagactccatcgagacggcctgtatgggccaaagtatggatggagtactcgccattggcggctgtgataaaaatatgccgggggctatgctcgccatggctcggatgaatattccggccatctttgtttacggcggcacgatcaaacccggacatctaaatggtgaagacttaaccgtggttagtgcctttgaagctgtgggtcagcatagtgctggacggattagtgaagccgagttaacggcagtggagaaacatgcttgtccgggtgctggatcctgtggcggtatgtatacggccaacaccatgtcttctgcgtttgaggcaatgggcatgagcctgatgtattcttccaccatggcagcggaagatgaagaaaaagccgtcagtgcagaacagtctgccgctgttttagtggaagcgatccacaagcaaattctgccccgcgatatcttgacccgcaaagcctttgaaaatgccattgctgtgattatggctgtaggcggatccaccaatgccgttctccacctgttggccatttcccgcgcggctggagactccctgaccctagatgacttcgaaaccatccgggctcaagttccagtgatctgcgatctcaaaccatcaggtcgctatgtagccacagatctccataaagcaggtggaatcccattggtgatgaaaatgctattggaacatggtcttctccatggtgatgctctgaccattacgggtaaaaccattgctgagcagttggctgatgtcccatcagagccttcccccgatcaggatgtaattcggccttgggacaatcccatgtataaacaaggccacctcgccatcctccggggtaacttggccacggaaggagcggttgccaaaatcacaggcattaaaaatccccaaattacgggtccagctcgggtatttgaatcggaagaggcttgcttggaggcgattttggcaggcaagattcagcctaatgatgtgattgtggtgcggtatgaaggcccgaagggtgggccgggaatgcgagagatgttagctcccacgtccgcgattattggggcaggtttgggtgattcagttggattgattacggatggtcgcttttctggtggaacttacggcatggtggttgggcatgtggccccagaagctgcggtgggtggtacgattgcccttgtgcaggaaggcgatcagattacaattgatgcccatgctcgaaagttggagctgcatgtgtctgatcaggagttaaaagagcggaaggagaagtgggagcaaccaaaacctctctataacaaaggggttttggcaaagtatgccaagttagtttcttctagtagtgttggagctgttactgatttagatctattttga

SEQ ID NO: 294 - protein, 561 aa, Acaryochloris marin
MSDNRNSQVVTQGVQRAPNRAMLRAVGFGDDDFTKPIVGLANGFSTITPCNMGIDSLATRAEASIRTAGAMPQKFGTITISDGISMGTEGMKYSLVSREVIADSIETACMGQSMDGVLAIGGCDKNMPGAMLAMARMNIPAIFVYGGTIKPGHLNGEDLTVVSAFEAVGQHSAGRISEAELTAVEKHACPGAGSCGGMYTANTMSSAFEAMGMSLMYSSTMAAEDEEKAVSAEQSAAVLVEAIHKQILPRDILTRKAFENAIAVIMAVGGSTNAVLHLLAISRAAGDSLTLDDFETIRAQVPVICDLKPSGRYVATDLHKAGGIPLVMKMLLEHGLLHGDALTITGKTIAEQLADVPSEPSPDQDVIRPWDNPMYKQGHLAILRGNLATEGAVAKITGIKNPQITGPARVFESEEACLEAILAGKIQPNDVIVVRYEGPKGGPGMREMLAPTSAIIGAGLGDSVGLITDGRFSGGTYGMVVGHVAPEAAVGGTIALVQEGDQITIDAHARKLELHVSDQELKERKEKWEQPKPLYNKGVLAKYAKLVSSSSVGAVTDLDLF

SEQ ID NO: 295 - DNA, 1683 bp, Lyngbya sp.
atgtcagataactttagaagtcaagccatcacccaaggaaagaaacgcacaccgaaccgggcgatgctccgagcggtagggtttggggatgaggactttaataagcctattgtcggcattgctaatggttacagtaccattactccctgcaacattggattgaacgatttggcgcatcgtgctgaaacggcattaaaacaagccgacgctatgcctcaaatgtttgggacgattactgttagtgatggcattgccatgggaaccgaggggatgaaatattctctggtttcccgagaggtgatcgccgatgcgattgaaactgcttgtaatgggcagagtatggatggcgttttggcgattggcggttgtgataaaaatatgcctggggcgatgattgcgatcgcgaggatgaatattccggcaatttttgtgtatggcggtacgattaaaccggggaatttaaacggttgtgatttaacggttgtcagtgcgtttgaggctgtcggcgaatacagcgccgggaaacttgatgatgatcgcttactcgatattgaacgccttgcttgtccgggttcggggtcttgtgggggaatgtttacggcaaatactatgtcttcggcgtttgaagcgatggggatgagtttaatgtattcttccacaatggcttctgaagatgcggaaaaggctgatagtaccgaaaagtctgcgtttgtgttgcgtgaggcgattagtcaacggattttaccgaagcaaattctcacccgcaaggcgtttgaaaatgcgatcgctgtgattatggcggtgggcggttcgacaaactcggtattacacttgttggcgattgcttatgcagcagatgtggaactgacgattgatgattttgaaacaattcggggacgggttccggttttatgtgatcttaaacccagtgggcgatttgtcacgacggattttcacaaagcgggtggcgttccgctgattatgaaaatgcttctcgaacagggtttaattcatggtgatgctttaacgattaccgggaaaacggttgccgaacagttggctgatattccctctcaaccgtctgcggatcaagaggtgattcgcccctggaataatccgatgtacaagcaagggcatttagcgattttgaagggaaatctcgccacagaaggcagtgttgctaaaattacaggcgtgaaaaaaccgcaaatgactggccccgcacgggtatttgagtcggaagaacagtgtttagaggcgattttagcgggtaaaattcaagctggagatgttttggtggttcgctatgaaggccccaaaggtggccccggaatgcgagaaatgttggcgccgacttccgcaattattggggcaggcttaggggattctgtgggcttgattaccgatggacggttttcggggggaacttatggcttggttgtcggtcatgttgccccagaagctgccgttggtggtaatattgcgttggttcaagagggcgatagtattacgattgatgcttcacaacggttattgcaggtgaatatttctgatcaggtattggaacaacgccgtcaaaattggcaaccgcctcaacctcgttacacaaaaggtgttttagctaaatatgcgaagttagtgtcttcgagtagtgtgggggcggtgacggatttagactgttaa

SEQ ID NO: 296 - protein, 560 aa, Lyngbya sp.
MSDNFRSQAITQGKKRTPNRAMLRAVGFGDEDFNKPIVGIANGYSTITPCNIGLNDLAHRAETALKQADAMPQMFGTITVSDGIAMGTEGMKYSLVSREVIADAIETACNGQSMDGVLAIGGCDKNMPGAMIAIARMNIPAIFVYGGTIKPGNLNGCDLTVVSAFEAVGEYSAGKLDDDRLLDIERLACPGSGSCGGMFTANTMSSAFEAMGMSLMYSSTMASEDAEKADSTEKSAFVLREAISQRILPKQILTRKAFENAIAVIMAVGGSTNSVLHLLAIAYAADVELTIDDFETIRGRVPVLCDLKPSGRFVTTDFHKAGGVPLIMKMLLEQGLIHGDALTITGKTVAEQLADIPSQPSADQEVIRPWNNPMYKQGHLAILKGNLATEGSVAKITGVKKPQMTGPARVFESEEQCLEAILAGKIQAGDVLVVRYEGPKGGPGMREMLAPTSAIIGAGLGDSVGLITDGRFSGGTYGLVVGHVAPEAAVGGNIALVQEGDSITIDASQRLLQVNISDQVLEQRRQNWQPPQPRYTKGVLAKYAKLVSSSSVGAVTDLDC

SEQ ID NO: 297 - DNA, 1686 bp, Synechocystis sp.
atgtccaacaatcccagaagccaggtaattacccagggcacccaacggagtcccaaccgggccatgctccgggccgttggttttggcgatgatgactttacgaaacccattgtgggtattgccaacgggtacagcaccattaccccctgcaacatgggcattaatgatctggctctacgggccgaggccggcttacggacagcgggggccatgccccaattgtttggcactatcaccatcagtgacggtatttccatgggtacggaagggatgaaatattccctagtttcccgggaagtgattgctgattccatcgaaacagtatgcaatggccaacgcatggacggagttttggcgatcgggggctgtgataagaatatgccgggggcaatgattgccatggctcgcctcaatattccctctatctttgtttacggtggcactattaaacccggacattatgccggggaagatttaacagtggtcagtgcctttgaagcggtgggccagtacagcgctggcaaaattgatgaggaaaccctctacggcattgaacggaatgcctgtcctggggctggttcctgtggggggatgttcaccgccaacaccatgtcctccgcctttgaagctatggggatgagcttgccctattcttctaccatggccgcagtggatggggaaaaagccgacagcaccgaggagtccgccaaggttttggtggaagccatcaaaaaacagattttgcccagtcaaattctgacccggaaagcttttgaaaatgccattgccgtgattatggccgtggggggctccactaatgcagtgctccatctgctggcgatcgccaacaccattggggtgcccctaagcttggacgattttgaaaccattcgccacaaagtacctgtactgtgcgacctcaaaccttccggcaaatacgtcaccactaatctccacgccgccggtggcattccccaggtgatgaaaatattgctggtcaatggcattctccacggtgacgctttaacgattacaggacagaccattgctgaagttttagccgatattcctgaccaaccccctgccggccaggacgtaatccattcctgggatgaccctgtttatcaagaaggtcacctggcagtgctcaaaggtaacctggccaccgaaggcagtgtggctaaaatcagcggtgttaaaaagccggtgatcactggtcccgccaaagtatttgaatctgaagaagattgcctagaagcgattctagccggcaaaattcaagcaggagatgtggtggtcgtgcgctatgaagggcccaaaggtggccccggtatgcgggaaatgctagcccccacttctgccatcattggggcagggttgggagactccgttggcctaatcaccgatggccgcttttctggtggtacctatggcttagtggtgggtcacgttgcccccgaagcttatgtgggaggggcgatcgccttggtgcaagagggggatcaaatcaccatcgatgctggcaagcggttactgcaactcaacatcagtgaagaggaattggcccaacggcgggcccaatggactcctcctcagccccgctatccccgggggattttagccaagtatgccaagttagtttcctccagcagccttggtgcagtgactgatatagacttgttctaa

SEQ ID NO: 298 - protein, 561 aa, Synechocystis sp.
MSNNPRSQVITQGTQRSPNRAMLRAVGFGDDDFTKPIVGIANGYSTITPCNMGINDLALRAEAGLRTAGAMPQLFGTITISDGISMGTEGMKYSLVSREVIADSIETVCNGQRMDGVLAIGGCDKNMPGAMIAMARLNIPSIFVYGGTIKPGHYAGEDLTVVSAFEAVGQYSAGKIDEETLYGIERNACPGAGSCGGMFTANTMSSAFEAMGMSLPYSSTMAAVDGEKADSTEESAKVLVEAIKKQILPSQILTRKAFENAIAVIMAVGGSTNAVLHLLAIANTIGVPLSLDDFETIRHKVPVLCDLKPSGKYVTTNLHAAGGIPQVMKILLVNGILHGDALTITGQTIAEVLADIPDQPPAGQDVIHSWDDPVYQEGHLAVLKGNLATEGSVAKISGVKKPVITGPAKVFESEEDCLEAILAGKIQAGDVVVVRYEGPKGGPGMREMLAPTSAIIGAGLGDSVGLITDGRFSGGTYGLVVGHVAPEAYVGGAIALVQEGDQITIDAGKRLLQLNISEEELAQRRAQWTPPQPRYPRGILAKYAKLVSSSSLGAVTDIDLF

SEQ ID NO: 299 - DNA, 1686 bp, Cyanothece sp.
atgtctgagaatgcaagaagtcgcctcattaccgagggaagtcaacgaacccctaaccgtgccatgttgcgtgctgtgggcttcggagatgatgattttaataagcctattgttggggtagctaatggcttcagtaccataaccccttgtaacatggggattaatgacctagctaaacgtgctgaagcaggaattaaaaccgctggtgggatgcctcagatattcggtaccattaccatcagtgatggcatttctatgggaaccgaaggcatgaaatattccctcgtctcacgggatgttattgccgactctatcgaaaccgtttgtaatggtcaaagcatggatggagtgatcgctattggtggatgcgacaagaatatgccaggggcaatgatagccatggcaagaatgaatatacctgcaatctttgtctatggaggaaccattaaacccggccattacaacggggaagatttaacagtagtcagtgcctttgaagcggtcggccaacatagtgcaggtaagatagatgatagcacattattggctattgaacgtaatgcttgccccggtgccggttcctgtgggggaatgttcaccgcaaataccatgtcttcagcgtttgaagtgatgggaatgagtttaccttattcttctacgatggcagcagaagatgcagaaaaagcagacagtacagaaaagtcagcttttgctttagttaatgccattcgtaaccagattttacccagtcacattttaacccgaaaagcctttgaaaatgccatttctgtaatcatggcggtgggaggttctacgaatgctgtattacaccttttagcgatcgctaataccatcggtgttgacctaactttagacgattttgaaaccattcgtcaacgggttcctgtactctgtgatttaaaaccatcgggacgctatgtaacggttaatttgcatgaagcgggtggcattcctcaagtgatgaaactattattaaatcatggattattacatggggatgcgttaacgatttccggtcaaactatagcagaaattttagccgatgtaccggatgaacctccagcgaatcaagatgttattcggacttgggataaccctgtttataaagagggacatttagccattttaaaaggtaatttagcctctgagggtgcagttgccaaaattagtggggtaaagaatcccaaaataacaggtccggcgcgagtttttgagtcggaagaggaatgtttagaggcaattttagcaggaaaaattaacgctggtgatgtcattattgtccgttatgaaggtcctagaggaggcccaggaatgcgagaaatgttagcaccaacttctgcaattattggggctggtttaggtgattccgtgggcttaattaccgatggccggttttctgggggaacctatggtttagtggtgggtcatgttgccccagaagcttacgtagggggtactattggcttagtaaaagaaggggatagtattaccattgatgctaaagaaaaactccttcaagtcaatgtttctgaagaagaattaaaccaacgtcgggctaattggaaagctcccgaacctcgttataaaagaggggtattaggtaagtatgccaagttagtttcttctagtagtttaggggcagttactgacgtgaatttgttttaa

SEQ ID NO: 300 - protein, 561 aa, Cyanothece sp.
MSENARSRLITEGSQRTPNRAMLRAVGFGDDDFNKPIVGVANGFSTITPCNMGINDLAKRAEAGIKTAGGMPQIFGTITISDGISMGTEGMKYSLVSRDVIADSIETVCNGQSMDGVIAIGGCDKNMPGAMIAMARMNIPAIFVYGGTIKPGHYNGEDLTVVSAFEAVGQHSAGKIDDSTLLAIERNACPGAGSCGGMFTANTMSSAFEVMGMSLPYSSTMAAEDAEKADSTEKSAFALVNAIRNQILPSHILTRKAFENAISVIMAVGGSTNAVLHLLAIANTIGVDLTLDDFETIRQRVPVLCDLKPSGRYVTVNLHEAGGIPQVMKLLLNHGLLHGDALTISGQTIAEILADVPDEPPANQDVIRTWDNPVYKEGHLAILKGNLASEGAVAKISGVKNPKITGPARVFESEEECLEAILAGKINAGDVIIVRYEGPRGGPGMREMLAPTSAIIGAGLGDSVGLITDGRFSGGTYGLVVGHVAPEAYVGGTIGLVKEGDSITIDAKEKLLQVNVSEEELNQRRANWKAPEPRYKRGVLGKYAKLVSSSSLGAVTDVNLF

SEQ ID NO: 301 - DNA, 1683 bp, Thermosynechococcus elongatus
atggcagaaaattggcgcagtcgcatcatcacagaaggcattcaacgcacccccaaccgagccatgctgcgagccgtgggttttggtgacgaggattttaacaagcccattgtgggggtggccagtgcccacagcacaattacgccctgcaacatggggattgctgcccttgccagtcgcgccgaagcaggaattcgggccgcgggagggatgccgcaattgtttggcaccattacggtcagcgatggtatttccatgggcactgaagggatgaaatactctttggtctcgcgggatgtgattgctgattcgattgagactgtctgtaatgcccagagtatggatggggtgctggcgatcggtggctgtgacaagaatatgcctggcgccatgattgccatggcacggatgaacattccagccatttttgtctatgggggtacgattaagcccggtcattggcaggggcaagaccttacggttgtcagcgcctttgaggccgtaggtcagtttagtgccggcaaaatggatgaggcaacgctccatgccattgaacaccatgcctgtccgggggcgggctcctgtggcgggatgttcacagccaatacgatgtcctcggcctttgaggccatgggcatgagtttaatgtattcctcaacgatgacggcggaagatgccgaaaaagctgacagcactgagttggcgggcaaggtgctggtggaggcaatccgcaaaaatattcgcccccgtgacattattacccgcaaatccattgaaaatgccatcagtgtgattatggctgtggggggatccacaaatgccgtgctgcattttctggcgatcgcccacagtgccgaggttcccttgaccattgatgattttgaaacgattcgccagcgggtgcccgttctctgcgacctcaagccctcgggtaaatacgtcactgcggatctacatcgggcagggggcattccccaagtcatgaaaatgctcctcaatgccggattgctccacggggattgcctaacgattactggagaaaccattgccgagcggctgcggcatgtgcccgatacccccgaccccaaccaagatgtgattcgtccttttgatcaacccttgtatgccacgggtcacctggctattctcaagggcaatctagccagcgaaggtgctgtagccaaaatctccggggtgaaaaatccccaaattaccgggcctgcccgcgtctttgactccgaggaagactgccttgacgccattctggcgggcaagatcaaccccggcgatgtcattgtcattcgctatgaaggccccgtcggcggtccggggatgcgggaaatgctggctcccacctctgccattattggtgcgggtttaggggatagtgttggcctcattaccgatggtcgcttttccggaggcacctatggcatggtcgtcggtcatgtggcgccggaagcggcagttggtgggacgatcgcccttgtgcaggagggagattcgattaccattgacgcccatcggcggctcctacaactgaatgtcagtgaggaagaactggcggcgcggcgggctaaatggcagccccctgcccctcgctacacccgtggtgtcttggctaaatatgccaaactagtgtcctctagtagtctgggagcggtgacggatcgctttgtctag

SEQ ID NO: 302 - protein, 560 aa, Thermosynechococcus elongatus
MAENWRSRIITEGIQRTPNRAMLRAVGFGDEDFNKPIVGVASAHSTITPCNMGIAALASRAEAGIRAAGGMPQLFGTITVSDGISMGTEGMKYSLVSRDVIADSIETVCNAQSMDGVLAIGGCDKNMPGAMIAMARMNIPAIFVYGGTIKPGHWQGQDLTVVSAFEAVGQFSAGKMDEATLHAIEHHACPGAGSCGGMFTANTMSSAFEAMGMSLMYSSTMTAEDAEKADSTELAGKVLVEAIRKNIRPRDIITRKSIENAISVIMAVGGSTNAVLHFLAIAHSAEVPLTIDDFETIRQRVPVLCDLKPSGKYVTADLHRAGGIPQVMKMLLNAGLLHGDCLTITGETIAERLRHVPDTPDPNQDVIRPFDQPLYATGHLAILKGNLASEGAVAKISGVKNPQITGPARVFDSEEDCLDAILAGKINPGDVIVIRYEGPVGGPGMREMLAPTSAIIGAGLGDSVGLITDGRFSGGTYGMVVGHVAPEAAVGGTIALVQEGDSITIDAHRRLLQLNVSEEELAARRAKWQPPAPRYTRGVLAKYAKLVSSSSLGAVTDRFV

SEQ ID NO: 303 - DNA, 1698 bp, Synechococcus sp.
atggccaattcccctttcccgctgcgcagccaagtggttacccagggagtacagcgctcccccaaccgcgccatgctcagggccgtaggctttcgcgacgaagacttcggcaagcccattgtcggcattgccaacgcccacagcaccctcaccccctgcaacatggggatccaaactctggcggagcgggcggaggcggctttgagaacggcgggctgtatgccccaggtgttcggcaccatcaccattagcgacggcatctcgatgggcacggaggggatgaaatactccctggtgtcgcgggaagtgattgccgattccatcgagacggtggtcaacggccagagcatggatggcctcttggccattggcggctgcgacaagaacatgccgggggcgatgatcgccatggcccgcctcaatgtgccctccatcttcgtctacggcggcaccatcaagccgggtcactacaatggccgcgacctcaccatcgtcagcgcctttgaagcggtgggggagttcagtgccgggcgcatctccgaggaagagctgctggcggtggagcgccatgcctgtcccggtgccggatcctgcggcggcatgtacacggccaacaccatgtccagcgcgtttgaggctatggggatgagtctgccctactcctccaccatggctgcagaagacgaagagaaagccgaaagtgccgcccaatcggccaaggtcttggcagaggccatcaaagccaacatccgcccccgcgacatcatcacccgtaaaagcattgaaaatgccatctcggtgatcatggccgtagggggatccaccaacgccgtgctccactttctggccattgcccatgcggcagaagtgcccctgacgctagatgatttcgagaccattcgtgctcgcgtgcctgtcctctgcgatctcaagccttcagggcggtttgtggccaccgacctgcaccgggccggtgggatcccccaggtgatgaaaatgctgctcaaccacggcctgctgcacggggactgcctcaccatctccggccagaccatcgtcgaagtcctgcgggatgtgccggacgagcctagcccggatcaggaggtgatccgcccttggcacagccccctgtatccccaagggcatctggccatcctcaaggggaatctggctcccgaaggagcagtagccaagattaccggcgtcaagaacccgcaaattaccgggccggcgcgggtcttcgattcagaggagtcctgcctgcaggccatcctctccggccagatccgagcaggggatgtggtggtgatccgctacgaaggccccaaaggtggccccggcatgcgggagatgctctcgcccacttcggccatcatcggcgccggcttgggggatagcgttggcctgatcaccgatggccgcttctccggcggcacctacggcatggtagtgggccatgtggctcccgaagcctatgtggggggcacgattgccctggtggaggaaggggatctcatcaccattgatgccccggctcgccagttgcacttgcatgtgagcgaagaagagctggcccgccgccgcgcccgctggtctcctcctgagcctcgctacaaacggggcaccctagccaagtacgccaagctggtctccagcagcagcctgggggcagtgacggatttaaacctgtgggattaa

SEQ ID NO: 304 - protein, 565 aa, Synechococcus sp.
MANSPFPLRSQVVTQGVQRSPNRAMLRAVGFRDEDFGKPIVGIANAHSTLTPCNMGIQTLAERAEAALRTAGCMPQVFGTITISDGISMGTEGMKYSLVSREVIADSIETVVNGQSMDGLLAIGGCDKNMPGAMIAMARLNVPSIFVYGGTIKPGHYNGRDLTIVSAFEAVGEFSAGRISEEELLAVERHACPGAGSCGGMYTANTMSSAFEAMGMSLPYSSTMAAEDEEKAESAAQSAKVLAEAIKANIRPRDIITRKSIENAISVIMAVGGSTNAVLHFLAIAHAAEVPLTLDDFETIRARVPVLCDLKPSGRFVATDLHRAGGIPQVMKMLLNHGLLHGDCLTISGQTIVEVLRDVPDEPSPDQEVIRPWHSPLYPQGHLAILKGNLAPEGAVAKITGVKNPQITGPARVFDSEESCLQAILSGQIRAGDVVVIRYEGPKGGPGMREMLSPTSAIIGAGLGDSVGLITDGRFSGGTYGMVVGHVAPEAYVGGTIALVEEGDLITIDAPARQLHLHVSEEELARRRARWSPPEPRYKRGTLAKYAKLVSSSSLGAVTDLNLWD

SEQ ID NO: 305 - DNA, 1683 bp, Gloeobacter violaceus
atgtccggcaatctgcgcagccgcatcgtcacccagggggtgcagcgctcccccaaccgcgccatgctgcgggcggtgggttttggcgacggtgatttcgagcggcccatcgtgggggtggccaacggcttcagcacgattaccccctgcaatctgggcctgggagctttggcggagcgggcggaggcggcgttgcgcgccggcggggcgatgccccaactattcggaacgatcacgatcagcgacggcatctcgatgggtaccgaggggatgaagtactcgctggtgtcccgcgaggtgatcgccgacagcatcgagacggtctgcaacggtcagagcctggacggggtgctcgctatcggcggctgcgacaagaacatgccgggtgcgatgatcgccattgccagactcaatatcccggcggtcttcgtctacggcggcacgatcaaacccggccgctaccaggatcaggacctcacggtcgtgagcgccttcgaagcggtgggccagtacagcgccggcaaaattgaccagacgaccctcgtcgaaatcgagcggcgcgcctgcccgggggcgggctcctgcggcggcatgtacaccgccaatacgatgagttcggccttcgaggcgatgggcatgagcttggtgtactcctcgacgatggccgccgaggatcccgaaaaagcggacagcaccgccctgtcggccaaggtgctggttgaagcgatccaagcgcaaatcctgccgagcgccatcctgacgcgaaaagctttcgagaacgccatcgctgtgatcatggccatcggcggctcgaccaacgccgtgctgcacctgcttgccatcgcccacagcgcccgggtgccactcgcactggatgacttcgagtgcatccgcgcgcgggtgccggtgctgtgcgatctcaagcccagcggtcgctttgtcgccaccgatctgcacagagccgggggtattccccaggtgatgaaaatgttgctcgtgcgcgggctcctccacggcgacgccctcacggtaaccggccagacggtcgccgaggtgctgcgcgacgtacccacagaaccgcgcaccgaccaggaggtgatccgtccctgggaccggcctctctacagttcggggcacctggccattttgcgcggcaacctggcgagcgaaggggcggtcgccaagattaccggcgtcaaaaagccccagatcactggtcctgcccgcgtcttcgactccgaagaaagctgcatggaagcaattctggcgggcgccatccagccgggcgatgtgatcgtcattcgctacgaaggccccaagggcggtcccggcatgcgggagatgctctcgcccacttcggccatcatcggcgcgggtctgggcgatgcggtgggactgatcaccgacggccgcttctcggggggcacctacggcatggtcgtgggccacgtcgccccggaagccttcgtgggcggcaccatcgccctggtcgaagcaggagatctgatcaccatcgacgccccggcgcgcaagatcgagctattggtgaccacagacgaactggagcgccgacgcgccgcctggcggccgcctgccccccgttacatccgcggggtgctcgccaagtacgcccgtcaggtgaacagcagcagcctcggggcggtcaccgacgcctttatttga

SEQ ID NO: 306 - protein, 560 aa, Gloeobacter violaceus
MSGNLRSRIVTQGVQRSPNRAMLRAVGFGDGDFERPIVGVANGFSTITPCNLGLGALAERAEAALRAGGAMPQLFGTITISDGISMGTEGMKYSLVSREVIADSIETVCNGQSLDGVLAIGGCDKNMPGAMIAIARLNIPAVFVYGGTIKPGRYQDQDLTVVSAFEAVGQYSAGKIDQTTLVEIERRACPGAGSCGGMYTANTMSSAFEAMGMSLVYSSTMAAEDPEKADSTALSAKVLVEAIQAQILPSAILTRKAFENAIAVIMAIGGSTNAVLHLLAIAHSARVPLALDDFECIRARVPVLCDLKPSGRFVATDLHRAGGIPQVMKMLLVRGLLHGDALTVTGQTVAEVLRDVPTEPRTDQEVIRPWDRPLYSSGHLAILRGNLASEGAVAKITGVKKPQITGPARVFDSEESCMEAILAGAIQPGDVIVIRYEGPKGGPGMREMLSPTSAIIGAGLGDAVGLITDGRFSGGTYGMVVGHVAPEAFVGGTIALVEAGDLITIDAPARKIELLVTTDELERRRAAWRPPAPRYIRGVLAKYARQVNSSSLGAVTDAFI

SEQ ID NO: 307 - DNA, 1674 bp, Nitrosomonas eutropha
atgccagacaatcgacgcagccaggccatcactaaaggtgcgaaacgtgctcccaatcgcgccatgttacgtgcagttggattcggtgacggagatttcgataagcccattgtcggcattgccaacggcttttccaccatcacgccttgcaacatggggctggatacgcttgccaaatgtgcggaacatgcattgaaaaatgccggtgccatgccgcaaatgttcggcacgattacggtatcggatggtatctccatgggcaccgaaggcatgaaatactcactggtatcacgcgaggtaatcgctgattccattgaaacctgcgtgcaggcggaaagcatggatggcgtcattgccattggcgggtgtgacaaaaacatgcctggtgccctaatcgcgctggctagactgaacgtgccatccatttttgtctatggcggcaccatcaagcccggtcactaccagggtcgcgatctgacaatcgtcagtgcgtttgaagcggttgggcaacatagcgcacacaagattgatgatcaggaactgctggaagttgaacgccatgcctgtcccggcgcaggttcgtgcggcggcatgtacaccgccaacaccatgtcctctgcgattgaggcgatgggcatgagtctgccccattcctccactatggctgcggaagatgaggaaaagcggatcagcgccacccgctctgccgaggtgctggtggaagcaatcaaaaaacagattctgccgcgcagcctgattacccgcaagtcactcgaaaatgcagtaacggtagtcatggccgtaggcggctcgaccaatgctgtgctgcatctgctggccatcgcccacgcagcagaagtagattttcatattgacgatttcgaagcgattcgtgcccgtgtgccggtgttgtgtgacctgaaaccttccgggcgctacgtcgccactgatctgcacagagcaggcggcattccacaagtgatgaaaatgctgctcgtgcacggtctgctgcatggtgactgtctgaccatcagcggacaaactatcgctgaagtactgaaagatattcctgaacaaccgcgcgcggatcaaaacgtcatccgcacctgggacaacccggtgtatgaacaaggtcatctggcgatcctgaagggtaatctttcgccggaaggtgcggtggccaagatttccggtgtaaaaaaccccaatattaccgggcccgccagagtgtttgaatccgaagaaacctgtatgactgccattctcgatcgcaaaatcaagccgggtgatgttgtcgttattcgctacgaggggccacgcggcggtcccggcatgcgtgaaatgctctcccctacttcggcgctaatcggtgaaggattgggtgattcggtcggattgattaccgatggccgtttttccggcggcacctacggcatggtcgtaggccatgtagcaccggaagcatacgccgggggagtgatcgctctggtggaagaaggagattcaatcacaatcgatgcgcatcgccgcctgttacaactgaatgtttcagaaacagaattggaacgccgccgggctgcctggcagccgcctgcgccgcgctacacacgcggtgtactggcaaaatatgccaaactggtatcaaccgccagtcgtggtgcggttactgattaa

SEQ ID NO: 308 - protein, 557 aa, Nitrosomonas eutropha
MPDNRRSQAITKGAKRAPNRAMLRAVGFGDGDFDKPIVGIANGFSTITPCNMGLDTLAKCAEHALKNAGAMPQMFGTITVSDGISMGTEGMKYSLVSREVIADSIETCVQAESMDGVIAIGGCDKNMPGALIALARLNVPSIFVYGGTIKPGHYQGRDLTIVSAFEAVGQHSAHKIDDQELLEVERHACPGAGSCGGMYTANTMSSAIEAMGMSLPHSSTMAAEDEEKRISATRSAEVLVEAIKKQILPRSLITRKSLENAVTVVMAVGGSTNAVLHLLAIAHAAEVDFHIDDFEAIRARVPVLCDLKPSGRYVATDLHRAGGIPQVMKMLLVHGLLHGDCLTISGQTIAEVLKDIPEQPRADQNVIRTWDNPVYEQGHLAILKGNLSPEGAVAKISGVKNPNITGPARVFESEETCMTAILDRKIKPGDVVVIRYEGPRGGPGMREMLSPTSALIGEGLGDSVGLITDGRFSGGTYGMVVGHVAPEAYAGGVIALVEEGDSITIDAHRRLLQLNVSETELERRRAAWQPPAPRYTRGVLAKYAKLVSTASRGAVTD

SEQ ID NO: 309 - DNA, 1674 bp, Nitrosomonas europaea
atgccagataatcgacgcagccaaaccattacccaaggtgcacaacgcacccccaaccgcgccatgttacgcgcagtcggtttcggtgacggagacttcgataaacctatcgtcggggttgccaacggtttttccaccatcacaccctgcaacatggggctggatacccttgccaaatgcgccgaacatgcgctgaaaaccgccggtgccatgccgcagatgtttggcaccatcaccgtatccgacgggatctccatgggtaccgaaggcatgaagtattctctggtttcgcgcgaagtgatcgccgattcgatcgaaacctgcgtacaggcggaaagtatggatggcgtcatcgccatcggtggttgcgataaaaacatgcctggcgccatgatcgcgctggccagactgaacgtaccgtccatcttcgtctatggcggtaccatcaaacctggccattaccagggccgtgatctgaccatcgtaagcgctttcgaagctgtcggacagcataccgcgcacaagatagacgatcatgaactgctggaagtcgaacgccatgcctgtcccggcgccggttcgtgcggtggtatgtacacagccaacaccatgtcatctgccatcgaggcaatgggaatgagcctgccttactcttccaccatggcagcagaagatgaggaaaaacggatcagcgccatacgctccgccgaagtactggtggacgcggtcaaaaagcagattctgccgcgcagcctgatcacccgcaaatccatcgaaaatgcggtatctgtcgtcatggcggtgggaggttcgaccaatgccgtgctgcacctgctggccatcgcccatgcagccgaagtggaattcagcatcgatgatttcgaagccattcgtgcacgcgtaccggtattgtgcgatctgaaaccttccggacgctatgtagccacggatctgcacaaagcgggcggtattccgcaagtgatgaaaatgttgctggtacacgacctgctgcacggcgactgtctgaccatcagcggacaaaccatcgcggaagtgctgaaagacattcccgaacagccgcgtgccgatcaggatgtgattcaaccctgggacaatccggtatatgaacaggggcacctggcgatcctgaaaggtaatctttcatcagaaggtgcggttgccaagatttccggcatcaaaaatcccagtattaccggtcccgccagagtgttcgattctgaagaaacctgcatggctgccattcttgaacgcaaaatccagccaggtgatgtggtggtcatccgctacgaaggcccacagggcggacccggcatgcgcgaaatgctttctcccacttcagcactgatcggtgaagggctgggtgattcggtcgggttgattaccgatgggcgtttctccggtggtacctacggaatggtggtgggccatgtggcaccggaagcattcgccggcggaacgatcgccctggtacaagagggagattcgattacgatcgatgcacaccgtcgcctgctgcaactgaatgttcctgaagccgagctggaacgccgccgggcagcctggcatccacctgcaccacgctacacacgcggcgtactggcgaaatacgccaagctggtatccactgccagccgtggtgcagtcaccgattaa

SEQ ID NO: 310 - protein, 557 aa, Nitrosomonas europaea
MPDNRRSQTITQGAQRTPNRAMLRAVGFGDGDFDKPIVGVANGFSTITPCNMGLDTLAKCAEHALKTAGAMPQMFGTITVSDGISMGTEGMKYSLVSREVIADSIETCVQAESMDGVIAIGGCDKNMPGAMIALARLNVPSIFVYGGTIKPGHYQGRDLTIVSAFEAVGQHTAHKIDDHELLEVERHACPGAGSCGGMYTANTMSSAIEAMGMSLPYSSTMAAEDEEKRISAIRSAEVLVDAVKKQILPRSLITRKSIENAVSVVMAVGGSTNAVLHLLAIAHAAEVEFSIDDFEAIRARVPVLCDLKPSGRYVATDLHKAGGIPQVMKMLLVHDLLHGDCLTISGQTIAEVLKDIPEQPRADQDVIQPWDNPVYEQGHLAILKGNLSSEGAVAKISGIKNPSITGPARVFDSEETCMAAILERKIQPGDVVVIRYEGPQGGPGMREMLSPTSALIGEGLGDSVGLITDGRFSGGTYGMVVGHVAPEAFAGGTIALVQEGDSITIDAHRRLLQLNVPEAELERRRAAWHPPAPRYTRGVLAKYAKLVSTASRGAVTD

SEQ ID NO: 311 - DNA, 1674 bp, Nitrosospira multiformis
atgtcagataaccagcgcagccgggcaatcacccagggggcggaacgtacccccaaccgcgcgatgctgcgggccgtaggtttcagcgacaacgatttcgacaaaccaatcgtcggcgtggccaatggcttttccaccatcacaccctgcaacaagggattgaacgaactggcgctggctgccgagcaggcattgaaacaggcggctgcgatgccccagatgttcggtaccatcaccgtttccgatggcatctccatgggaacggagggcatgaagtattcactggtatcccgcgaagtcattgccgactcgatcgaaacggcggtgcaggccgaaagcatggatggcgtgatcgccatcgggggctgtgacaagaacatgccaggagcaatgatcgccattgcgcgcatgaatgttcccgcaatttttgtttatggcggaacgattaaaccgggccactataaaggaaaggatctcactattgtcagcgcattcgaagccgtcggacaatatacctcccacaagatagacgcgaaagaactgctcgaagtggagcgccacgcctgtccgggagccggctcctgcggaggcatgttcactgccaatacgatgtcgtccgctttcgaagcgatgggcatgagtctcccctattcttccacgatggccgcggaggatggcgagaagctaaccagcgcggcgcgctccgcggaagtgctcgtggatgccatcaggaaacagattcgcccgcgcgacatcattacccgcaagtccattgaaaacgcgatcgcggtgatcatggccgtgggtggttccaccaatgctgttttgcacttcctcgccattgcccatgcggccgaagtgacactcaccatcgatgattttgaacgcatgcgcggcaaagtgccggtactgtgcgatctcaaaccttcgggacggtacgttgccaccgacctgcacaaggcagggggcattccccaggtcatgaaaatgctgctcgaccacggcctgttgcatggcgactgcatcaccatcagcggacagaccattgccgagatattgaaggatgtgccgtcagagcctcgcgaagatcaggatgtcattcgccagtgggacaacccgttgtacgtccagggccacctcgccatactcaagggcaatctcgccccagaagggtgcgtggcgaaaatcaccggggtgaaatccccaaaaattaccggaccggcacgcgtattcgattcggaagaagcctgcatggcagctatccttgcgcgggagatccagcccggcgacgtggtggtgatacgctatgagggacccaagggcggccccggcatgcgggaaatgctgtctcccacttccgcgcttattggcgagggactcggagattcggtgggcctgatcaccgatggacgattctccgggggcacctatggaatggtggttggacacgtggcgccggaggcgttcgtaggcgggaccattgcgctggtgcgagaaggcgattcgattaccatagacgccgagcaacggctgctgcagctcaacattcccggagatgagctggctcggcgccgggctgaatggcaaccgccccatccgcgctacacccggggagtgctcgctaaatattcgaagctcgtctcgagtgccagccgcggcgcaatcaccgactag

SEQ ID NO: 312 - protein, 557 aa, Nitrosospira multiformis
MSDNQRSRAITQGAERTPNRAMLRAVGFSDNDFDKPIVGVANGFSTITPCNKGLNELALAAEQALKQAAAMPQMFGTITVSDGISMGTEGMKYSLVSREVIADSIETAVQAESMDGVIAIGGCDKNMPGAMIAIARMNVPAIFVYGGTIKPGHYKGKDLTIVSAFEAVGQYTSHKIDAKELLEVERHACPGAGSCGGMFTANTMSSAFEAMGMSLPYSSTMAAEDGEKLTSAARSAEVLVDAIRKQIRPRDIITRKSIENAIAVIMAVGGSTNAVLHFLAIAHAAEVTLTIDDFERMRGKVPVLCDLKPSGRYVATDLHKAGGIPQVMKMLLDHGLLHGDCITISGQTIAEILKDVPSEPREDQDVIRQWDNPLYVQGHLAILKGNLAPEGCVAKITGVKSPKITGPARVFDSEEACMAAILAREIQPGDVVVIRYEGPKGGPGMREMLSPTSALIGEGLGDSVGLITDGRFSGGTYGMVVGHVAPEAFVGGTIALVREGDSITIDAEQRLLQLNIPGDELARRRAEWQPPHPRYTRGVLAKYSKLVSSASRGAITD

SEQ ID NO: 313 - DNA, 1695 bp, Chloroflexus aggregans
atgagcgataatcgccgtagtcgtatgattaccgaaggcccacagcgttcacccaatcgggcaatgctgcgcgcggtcgggtttggcgacaacgattttacgaagccgatcgtgggagtggctaacggtcacagtacgctgacaccgtgcaacgccggcttaggggcgttggcagcgcgggcggaagccgctattcgtgccgcaggaggtatgccgcagatcttcggcacgatcacggtcagcgatggtatctcgatggggactgaagggatgaagtattctttggtcagccgcgaggtgattgccgattcgattgagacggtcgtcaacgcacagcggatggacggaatccttgcggtgggtggctgcgataagaacatgcccggcgccttaattgccatggcccggctcgacattccggccatctttgtctatggtggtactatcaaacccggtcattacaaaggccgtgacttgaccatcgtcagcgtgtttgaggcagttggcgaatacagtgccggtcggatcgacgaacacgagttgctcgaaatcgagcgtcacgcatgccccggcgtcggttcgtgtggtggtatgtacactgccaatacgatgtcgtcggcaattgaagcgctgggcttgagtttacccggctcttcaaccatggctgccgaagacgaggaaaaggcgatcagcgcagctcgttccggcgaggtgttagttgaggccatccgcgccaatcgcacagcgcgccagatgttgacccgcaagtcgtttgagaatgcgattgcagtagtgatggcgttaggtggctcgaccaacgccgttttgcatctgctggcgattgcctatgctgccaacgtaccgttgaccatcgatgattttgagacgatccgccagcgggtaccggtgctctgcgatctcaagccatcgggccgctatgtggcgaccgatctccaccgtgtcggtggtgtaccgcaggtgatgaagatgttgttgaatgccggcttactccacggtgattgtatgacgattaccggacagacaatcgctgaggtgctggccgatgtacccgacgagccgccggccgatcaagatgtcatccgcccctttcataaacccctctatccgcaaggacatttggccatcctccgtggtaatctggccgaagaaggctgcgttgcgaagattaccggtattaagcagcgctcgattaccggaccggcccgtgttttcgatgccgaagaggaatgtctcgaagcgattttgagtggcaagattaagccgggcgatgtcgtggtgatccggtacgaagggccgaagggtggtcccggtatgcgtgaaatgctcgctccgacatcggcgattatcggtgccggtttgggcgatagcgttggcctgattaccgacggacgcttctctggtggtacgtatggcttggtggtcggtcatgttgcccctgaagcggcggttggtggcaccattgccctggtcgaagagggtgatagtatcacgattgacgccgatgcccgtctcttgcagctcaatgtctcggacgaagagttggcacgacgccgtgctgcgtggcaaccccgtccgccacgctatacccgtggtgtattggcgaagtatgccaggctggtgtcgtcggctagccttggtgcagtgaccgaccgcttcgatggcgagtcggcgtaa

SEQ ID NO: 314 - protein, 564 aa, Chloroflexus aggregans
MSDNRRSRMITEGPQRSPNRAMLRAVGFGDNDFTKPIVGVANGHSTLTPCNAGLGALAARAEAAIRAAGGMPQIFGTITVSDGISMGTEGMKYSLVSREVIADSIETVVNAQRMDGILAVGGCDKNMPGALIAMARLDIPAIFVYGGTIKPGHYKGRDLTIVSVFEAVGEYSAGRIDEHELLEIERHACPGVGSCGGMYTANTMSSAIEALGLSLPGSSTMAAEDEEKAISAARSGEVLVEAIRANRTARQMLTRKSFENAIAVVMALGGSTNAVLHLLAIAYAANVPLTIDDFETIRQRVPVLCDLKPSGRYVATDLHRVGGVPQVMKMLLNAGLLHGDCMTITGQTIAEVLADVPDEPPADQDVIRPFHKPLYPQGHLAILRGNLAEEGCVAKITGIKQRSITGPARVFDAEEECLEAILSGKIKPGDVVVIRYEGPKGGPGMREMLAPTSAIIGAGLGDSVGLITDGRFSGGTYGLVVGHVAPEAAVGGTIALVEEGDSITIDADARLLQLNVSDEELARRRAAWQPRPPRYTRGVLAKYARLVSSASLGAVTDRFDGESA

SEQ ID NO: 315 - DNA, 1674 bp, Leptospirillum sp.
atgaaaaagccatttcgaagccggaccatcacccagggagtggaaagatctcccaacagggccatgctccgggccgtcgggttccaggatggggattttgaaaaaccgattatcggagtggcgaatggctacagcaccattacaccctgcaacatgggcctgaacagtctggctcttcgtgccgaggacgccattcgccagagaggagccatgccccagatgttcggaaccatcacggtttcggacggaatatcgatgggaacggaaggaatgaagttttccctggtgtcccgggaagtcatcgccgactccatcgaaacggcggtcagcgcccaaagcatggacggcgtgatcgccatcggggggtgcgacaagaacatgccgggagccctgatcgccatggggcgcatgaacatcccctccatttttgtttatggaggaaccatcaagcccggccactgggaaggtcaggacctgacggtcgtgagctcgttcgaagcggtcggggcctactcggcaggcaagatggacgaggcaaccctgaccgaaatcgagcgtcatgcctgtccgggagccggatcctgtggcggcatgttcactgccaataccatgtcgtcggcgatcgaagccatggggatgagtttgccctattcctccaccatggcagcggaagaccttgaaaaagccgaaagcgcagccgaatccgcaagagttcttgtccaggcggttctgaacgacctgcgtcctcgacagatcctgaccagaaaggcctttgaaaacgccattgcagtcctgatggccgttggaggctcgacgaacgcggttcttcacctcctcgcgatcgcccgctccgtcgacgtccccctttccatagacgactttgaacacattcgacgaaaggtccctgtcctttgcaacctcaagccctccggggcctatgtcgccacacagcttcacgctgtcgggggcattcccctcgtcatgcgcatgctgctggacaacggactccttcatggcgacgcgctgaccattacagggaagacgatttccgagacgctccgggacgttccttcccgtcccccggccggacaggatgtcgtgctcccctttgacaaacccgtttaccgggagggccaccttgcgatcctgaagggaaatctcgccccggaaggatcggtcgcaaagatctcgggcatcaaacaccgttccattaccggcccggcccgggtcttcgactccgaagaacgctgcatggcagccatcctggcccgggaaattcgtcccggagacatcgtcgtgatccggtacgaaggccccaaaggcggtcccggaatgcgggaaatgctggccccgacctccgccctgatcggagaaggtctcggggactcggtcggcctgattacagatggacgtttttccgggggcacatacggcatggtggtgggtcacgtctcgccggaagcggctgtgggcgggccgatcggactggtgcaggaaggagacctcattacgatcgacgccgaccggaatctgatcgaggtcaaggtttcaccggacgaaatgacaagaagaaaatctctgtggaaggaaccccctctccgatacacaaaaggaatcatggccaaataccgtcttctcgtcaaaagtgccagcgaaggcgccgtgacagactga

SEQ ID NO: 316 - protein, 557 aa, Leptospirillum sp.
MKKPFRSRTITQGVERSPNRAMLRAVGFQDGDFEKPIIGVANGYSTITPCNMGLNSLALRAEDAIRQRGAMPQMFGTITVSDGISMGTEGMKFSLVSREVIADSIETAVSAQSMDGVIAIGGCDKNMPGALIAMGRMNIPSIFVYGGTIKPGHWEGQDLTVVSSFEAVGAYSAGKMDEATLTEIERHACPGAGSCGGMFTANTMSSAIEAMGMSLPYSSTMAAEDLEKAESAAESARVLVQAVLNDLRPRQILTRKAFENAIAVLMAVGGSTNAVLHLLAIARSVDVPLSIDDFEHIRRKVPVLCNLKPSGAYVATQLHAVGGIPLVMRMLLDNGLLHGDALTITGKTISETLRDVPSRPPAGQDVVLPFDKPVYREGHLAILKGNLAPEGSVAKISGIKHRSITGPARVFDSEERCMAAILAREIRPGDIVVIRYEGPKGGPGMREMLAPTSALIGEGLGDSVGLITDGRFSGGTYGMVVGHVSPEAAVGGPIGLVQEGDLITIDADRNLIEVKVSPDEMTRRKSLWKEPPLRYTKGIMAKYRLLVKSASEGAVTD

SEQ ID NO: 317 - DNA, 1677 bp, Leptospirillum sp.
atgaaagacaaccggagaagtcgtgtcacgaccgaaggcgtggagcgctctcccaaccgggccctgcttcgggccacggggttccgggacgacgattttggcaagccgattgtcggggtggcgaacgcccacagttccatcaccccctgcaatatggggatcgggaaactcgcttcgcgggcggaagaagctctccgcaaggccggctccatgccccagaccttcgggaccatcacggtgtcggacggaatctcgatgggcaccgaaggcatgaaatattccctcgtctcgagggaagtgattgccgattcgatcgaaacggtcgtgaacgcgcagagcatggacggccttctggcgttcgggggatgcgacaaaaacatgccgggggcactgatcgcgatgggccgtctcgacattccctccgtcttcgtctacggagggacgattcgtccgggacaccacaacggacaggacctgaccgtcgtcagcgccttcgaggccgtcggggaatatctcgcgaaccggatcgaccgggaagaacttctggcaatcgaacgccacgcctgtcccggagccggatcctgcggcgggatgtttaccgccaacaccatggcagccctgatcgaaaccatgggcatgagcctcccctattcctccacgatggccgccgaagacgcggaaaaatcggaaaacgcggaagagtccgcgaagatcctggtcaacgccatccggaaccagatccgtccccgccagattctgacgcggcatgccttcgaaaatgcgatcgcggtcacgatggccatcggagggacgaccaacgccgttctgcatctccttgccatcgcccgggcggtcgaggttccgctttcgatcgacgacttcgccgcaatccgggaacgggtccctgttctgtgcgatctcaagccatgggggcggtatgtggcaaccgaccttcaccgggcgggagggattccccaggtcatgaaaatcctgttgtcgaacggactgttgcatggggaagccctttccgtcaccggccggaccatcgcggaactgctggaaaacatcccggaagaccccccgaaagaagatcaggatgtgattcgtccgtttcgcgcgccggtcctcgaacgggggcatatcgccatcctccggggaaacctcgcccccgacggatcggtggccaaagtgacggcctcccgtcctgtggcattcacgggaccggcccgtgtcttcgattcggaagaagacggcatgaaggccattctggcaagagagatccgtccgggagatgtcgtagtcatccgttacgagggtcccgtgggaggaccgggcatgcgggaaatgctcgcaccgaccgccgcccttgtcggggaaggcctgggggagagcgtggcgctggtcacggatggacggttctccggaggaacccgggggatggtcgtgggtcatgttgcacccgaagcggccgtgggaggaccgatcgccctggttgccgacggcgatccggtcacggtcgaccccggacggagctgtctccggctcgatgtgccggaggaggaatttctccgccggcaggccgcatggcgtccccgtccgccccgcaccctccggggggttctggcgaagtacgcccggcaggtctcttcggccagcgaaggcgccgtcaccgactga

SEQ ID NO: 318 - protein, 558 aa, Leptospirillum sp.
MKDNRRSRVTTEGVERSPNRALLRATGFRDDDFGKPIVGVANAHSSITPCNMGIGKLASRAEEALRKAGSMPQTFGTITVSDGISMGTEGMKYSLVSREVIADSIETVVNAQSMDGLLAFGGCDKNMPGALIAMGRLDIPSVFVYGGTIRPGHHNGQDLTVVSAFEAVGEYLANRIDREELLAIERHACPGAGSCGGMFTANTMAALIETMGMSLPYSSTMAAEDAEKSENAEESAKILVNAIRNQIRPRQILTRHAFENAIAVTMAIGGTTNAVLHLLAIARAVEVPLSIDDFAAIRERVPVLCDLKPWGRYVATDLHRAGGIPQVMKILLSNGLLHGEALSVTGRTIAELLENIPEDPPKEDQDVIRPFRAPVLERGHIAILRGNLAPDGSVAKVTASRPVAFTGPARVFDSEEDGMKAILAREIRPGDVVVIRYEGPVGGPGMREMLAPTAALVGEGLGESVALVTDGRFSGGTRGMVVGHVAPEAAVGGPIALVADGDPVTVDPGRSCLRLDVPEEEFLRRQAAWRPRPPRTLRGVLAKYARQVSSASEGAVTD

SEQ ID NO: 319 - DNA, 1698 bp, Halorhodospira halophila
atggcggataaccgtcgcagccgagtgatcacccagggcgtggcccgaacccccaaccgcgcgatgctgcgcgccgtcggtttccgggatgaggatttcgagaagccgatcatcggggtcggcaacgcgcacagtacgatcaccccctgcaacgtcgggatcggcgccatggcgcggcgcgccgaggaggcgctgcgcgaggtgggggcgatgccgatgaagttcggcaccatcaccgtctccgacgggatcaccatgggcaccgagggcatgaagtactccctggtctcccgcgaggtgatcgccgattcgatcgagacggtgggcggtggccagcggatggacggcatgctcgccactggtggctgcgacaagaacatgcccggggcgatgatggccctggcccgtctggatatcccgggtatcttcgtctatggcggcaccatcaagccgggtcattacaagggcgaggatctcaccgtggtcagcgccttcgaggcggtggggcagtacaacgccggcaacctctccgaggccgatctcaagggggtcgaggagaacgcctgccccggggcgggcgcctgtggcggcatgttcacggccaacaccatgtccagcgccttcgaggccatgggcatgagcctgatgggctcgtccaccgtctctgccgaggacgacgaggcccgggatgtggccgccgaggcgtcccgggtcctgatggacgctgtccatcacgaccggcgcccgtcctcgatcctcacccgcgaggccttcgagaacgcctttgcggtggtgatggccctgggcggctccactaacgccgtgctccacctgctggccatcgccaataccgccgaggtgccgttcgacctcgacgacgtcgagcgcatccgccgcaaggtgccggtactctgcgacctcaagccgtcgggccggttcgtgaccagtcagttccacgaggtcggcggcacgccgcaggtgatgcgcatcctcctggagcaggggctgttgcacggccactgccagaccatcaccgggcagaccatcgaggccctcatcggccacctgccgccggagccgccggcggatcaggagatcatcatgcccttcgatcggccgctctatcccgagggtcacctggcaatcctgcggggcaacctggctgaagagggtgccgtggccaaggtcagtggcatccaacagcgccgtatcagcggaccggcccgcgtgttcgattccgaggaggagtgcctggaggccatcctggccgacggggtgcaggccggtgacgtggtgatcgtccgctacgaggggcccaagggagggcccggcatgcgcgagatgctggcgcccacctcggcgatcatcggcaaggggctcggcgatgcggtggggctgatcactgacggccgtttctccggcgggacctacgggatggtggtcgggcacgtggcgcctgaggcctacgacggcgggaccatcgcgctgattgccgagggcgatacggtgaccatcgacgccgaccagaacctgcttcaggtggaggtggatgacgcggagctcgagcgtcgccgcagccagtggcaggtgccccggcctcgctaccgtcgcggggtgttgggcaagtatgcgcgcctggcggcctcggccagtcgcggtgcagtgaccgacgccgacctcttccccgagcaggagtag

SEQ ID NO: 320 - protein, 565 aa, Halorhodospira halophila
MADNRRSRVITQGVARTPNRAMLRAVGFRDEDFEKPIIGVGNAHSTITPCNVGIGAMARRAEEALREVGAMPMKFGTITVSDGITMGTEGMKYSLVSREVIADSIETVGGGQRMDGMLATGGCDKNMPGAMMALARLDIPGIFVYGGTIKPGHYKGEDLTVVSAFEAVGQYNAGNLSEADLKGVEENACPGAGACGGMFTANTMSSAFEAMGMSLMGSSTVSAEDDEARDVAAEASRVLMDAVHHDRRPSSILTREAFENAFAVVMALGGSTNAVLHLLAIANTAEVPFDLDDVERIRRKVPVLCDLKPSGRFVTSQFHEVGGTPQVMRILLEQGLLHGHCQTITGQTIEALIGHLPPEPPADQEIIMPFDRPLYPEGHLAILRGNLAEEGAVAKVSGIQQRRISGPARVFDSEEECLEAILADGVQAGDVVIVRYEGPKGGPGMREMLAPTSAIIGKGLGDAVGLITDGRFSGGTYGMVVGHVAPEAYDGGTIALIAEGDTVTIDADQNLLQVEVDDAELERRRSQWQVPRPRYRRGVLGKYARLAASASRGAVTDADLFPEQE

SEQ ID NO: 321 - DNA, 1689 bp, Nitrococcus mobilis
atggccgataatcgccgcagccgcgtgatcacctacggtgtggcccgtacgcctaatcgggccatgctgcgcgctgtcggttttaccgacactgatttcgataaaccgatcgttggagtgggcaatgcccacagcaccatcacaccctgtaatgtgggcatcggtgcattagcggctcaggccgaacaggcgctgcgtgaagccggtgccatgccggtcagctttggcaccatcactatttctgatggtatatccatgggcacggaggggatgaagtactcgctggtctcgcgcgaggtcatagccgatgccatcgaaacggtaggcaacggccagtgcctggatggcatgctcgccaccggtggttgcgacaagaacatgccgggcgccatgattgccatagcacgcatgaatattccggcgatcttcgtttatggcggcaccatcaagccgggtcgctataagggtcaggatctgaccatcgtcagcgctttcgaggcggttggacagtatgccgccggcaaactctcagtcgaggatttgcagggcgtggaacgcaacgcttgccccggtgccggtgcctgcggcgggatgtacacggctaataccatgtccagcgccttcgaggccttgggtatgagcctgatgggctcctccaccctgtgcgcggaggatccggagaaagtgcagagtgcgcggcgctcggctcaagtcctggtagacgccatccaggaacagcgtttaccgcgtgccataatgacccgccaggcgttcgaaaacgcctttgcggtggtcatggcgctcggcggatcgaccaatgccgtgctgcatttgttggcgatcgccaacgctgcggaggtcgattttagcattgacgatgtcgaaaccatccgccgccaggtgcccgtgctctgcgagctcaagccctccgggcgcttcgtaaccagccagtttcatgaggtcggcggtactccgcaggtcatgaagatccttttggcccacggcttattgcacggcgcttgccttactgtttccgggcattctattgctgaattgttggccgacataccggccgagccgccgagcgaccaggatatcattcggcctttcaagcagccgctgtacccgcagggacatctcgccatcctgcgcggcaatctggcggaggagggtgccgtcgccaaggtcaccggcatcaaacagcgccggatcacaggtccggcacgggttttcgactccgaagagggtgccctggaggcgattctggcggatcaaatcgtggcgggtgacatcgtcgtgattcgttatgagggcccgaagggtgggccgggcatgcgcgagatgctggcgccgacctcggcgatcatcggtaaaggtttgggtgatgcggtaggtcttattaccgacgggcgcttctccggtggtacctatgggatggtggtcggtcatgttgcaccagaggcggcagtcggcggtacgattgccttggtgcgggagggtgatgaaatcacgatcgatgccgatcgcaatctgctgatgctccatgtcgccgacacggaaattgtccagcgccgagccgcctggcagccgccacggcctatttatcgtcgcggtgtgctcgcgaagtacgccaagttggtctcctcggcgagcattggagcggttacggacaaagatctattcgactga

SEQ ID NO: 322 - protein, 562 aa, Nitrococcus mobilis
MADNRRSRVITYGVARTPNRAMLRAVGFTDTDFDKPIVGVGNAHSTITPCNVGIGALAAQAEQALREAGAMPVSFGTITISDGISMGTEGMKYSLVSREVIADAIETVGNGQCLDGMLATGGCDKNMPGAMIAIARMNIPAIFVYGGTIKPGRYKGQDLTIVSAFEAVGQYAAGKLSVEDLQGVERNACPGAGACGGMYTANTMSSAFEALGMSLMGSSTLCAEDPEKVQSARRSAQVLVDAIQEQRLPRAIMTRQAFENAFAVVMALGGSTNAVLHLLAIANAAEVDFSIDDVETIRRQVPVLCELKPSGRFVTSQFHEVGGTPQVMKILLAHGLLHGACLTVSGHSIAELLADIPAEPPSDQDIIRPFKQPLYPQGHLAILRGNLAEEGAVAKVTGIKQRRITGPARVFDSEEGALEAILADQIVAGDIVVIRYEGPKGGPGMREMLAPTSAIIGKGLGDAVGLITDGRFSGGTYGMVVGHVAPEAAVGGTIALVREGDEITIDADRNLLMLHVADTEIVQRRAAWQPPRPIYRRGVLAKYAKLVSSASIGAVTDKDLFD

SEQ ID NO: 323 - DNA, 1692 bp, Alkalilimnicola ehrlichei
atgagtgagaaccgccgcagtcgggtcgtgaccgcaggcctgcgccgcacccccaaccgggccatgctgcgcgccaccggcttccgggacgaggacttcgacaagcccatcatcggcgtcgccaacgcccacagcaccatcaccccctgcaacatgcatatcgccgcgctcacccggcgggcggtggaggcgttgcaggcggccggtgccatggcaccggaatttggcgtgcccaccgtctcggacggcatcgccatgggcacgccggggatgcgctactcgctggtctcgcgcgaggtgatcgccgacgccatcgagacggtgtgcgagggccagagcctggacggcgtgctggccaccggcggctgcgacaagaacatgcccggggctatgatcgccatcgcgcgcatgaacataccggccctgtttgtctacggcggcaccatccgccccggctactacaagggcgagcggctggacatcgtctcggcgttcgaggcggtgggccaggcctccgcgggcaggatgagtgacgaggacctgcttggggtggagcgcaacgcctgccccggcgccggctcctgtggcgggatgtacaccgccaacaccatgtccagcgccttcgaggccatgggcatgagcctgcccgccagctccaccgtggccgccgaggcggaggagaagggcgacgacgtggcggccgccgcgcgggtgctgatggaggcggtgcgggcggatcgcaagccccgcgacatcctcacccgcgaggccttcgagaacggcttcgccctggtgatggccgtgggcgggtccaccaacgcggtgctgcacttgctggccatcgccgatgcggccgatgtgccgttgtcgctggacgacgtggagcgtatccggcagcaggtgcccgtgctctgcgatctgcggccctcgggccgctacgtgaccactgaatttcacgaggtgggcggcacgccgcaagtgctgcgcctgctgctggacgcgggcctgctccacggcgactgcctcactattaccgggcagacgcttgccgagaccctggccgacgtgcccccgacccccgcgaaggatcaggacatcatccggaccctggacaaccccctctacccggtgggccatctggccatcctgcgtggaaacctggcagaggagggggccgtggccaaggtgtccggccttaagcagcgccgcatcgtcggaccggcgcgggtattcgagggtgaggaggactgcctggaggcgatcctggccggccagattaagcccggcgacgtggtggtcatccgccacgaggggccgaagggcgggcccggcatgcgcgagatgctctcgcccaccgcggcgttgatgggggccgggctgggggagagcgtcggcctgatcaccgatgggcgcttctccggtggcacccgggggctggtggtgggccacgtggcgccggaggccgcagcgggtggcaccatcgccctggtccgggaaggcgacaccgtcaccatcgatgcggacgccaaccggctcaccctggaggtggacgaggcggagctcgcccgccggcgtgcggcctggcagccgccggaaccgagagcgacccggggcgtattgggcaagtacgcgcagatggtcggctcggcggcgcagggtgcggtcaccgatcgctggagcggcggcgcgtga

SEQ ID NO: 324 - protein, 563 aa, Alkalilimnicola ehrlichei
MSENRRSRVVTAGLRRTPNRAMLRATGFRDEDFDKPIIGVANAHSTITPCNMHIAALTRRAVEALQAAGAMAPEFGVPTVSDGIAMGTPGMRYSLVSREVIADAIETVCEGQSLDGVLATGGCDKNMPGAMIAIARMNIPALFVYGGTIRPGYYKGERLDIVSAFEAVGQASAGRMSDEDLLGVERNACPGAGSCGGMYTANTMSSAFEAMGMSLPASSTVAAEAEEKGDDVAAAARVLMEAVRADRKPRDILTREAFENGFALVMAVGGSTNAVLHLLAIADAADVPLSLDDVERIRQQVPVLCDLRPSGRYVTTEFHEVGGTPQVLRLLLDAGLLHGDCLTITGQTLAETLADVPPTPAKDQDIIRTLDNPLYPVGHLAILRGNLAEEGAVAKVSGLKQRRIVGPARVFEGEEDCLEAILAGQIKPGDVVVIRHEGPKGGPGMREMLSPTAALMGAGLGESVGLITDGRFSGGTRGLVVGHVAPEAAAGGTIALVREGDTVTIDADANRLTLEVDEAELARRRAAWQPPEPRATRGVLGKYAQMVGSAAQGAVTDRWSGGA

SEQ ID NO: 325 - DNA, 1695 bp, Deinococcus geothermalis
atgacggacacccgcaccaagcgcagaatgaactggaacagtcaccacatcacgcagggtgacgagcgggcgcccaaccgcgcgatgctgcgggcggtgggcttcgaagacggcgacttcgacaaggcgatcatcggggtggcgcacgcccagagcaacatcacgccctgtaacaacgggctgggcgaactcgccgaccacatcaccggtgcgcttcgcgagggcggagcgatgccgcaggtgtacggcaccatcacggtgtctgacggcatcagcatgggcaccgagggcatgaagtgctctcttgtcagccgggaagtgatcgcagactccatcgaaaccgtctcgcgtgggcaatcgcacgacggcctgattgtggtgggcggctgcgacaagaatatgcccggcgcaatgatcggcatcgcccggttgaatattcccgcgatcttcgtgtacggcgggaccatcaaaccggggcactatcagggcaaagacctcaccatcgtttcggtcttcgaggcggtgggggcctacggcgcgggcaagatgagccgcgaggacttcgagcagatcgagaaacgcgcctgtcccggcaacggttcctgtggcggcatgtacaccgccaacaccatgagcagtgccttcgaggcgatgggcatgagcctgccctattcgtccaccatgagtgccgtggacgccgaaaaggccgtttcggctgcggacagcgcccgcgccctgatccggttgatcgagcaggacatccgcccgctggacatcctgacgaaaaaagcctttgagaacgccatcacggtggtcatggcggtgggcggctcgaccaacgccgtgctgcacctgatggcgattgcccacgcctgcggtgttgacctcacgctggaagacttcgagcgcattcgcgagcgcacgccggtcttctgtgaccttaagcccagtggaaagtacgtcgccacggatctgcacgaggtcggcggcattccgcgcgtgatgaagatgctgctcaaagcgggcttgctgcacggcgactgcctgacagtgaccggacagacggtggccgagaacctggcggacgtgcccgaccagcccgaccccggccaggacgtcattctgcccttcgatcagccgctctactcgcaggggcacctcgccatcttgcggggcaacctggccccggaaggcagtgtcgccaagatcagcggcctgcggcagatcaagatcaccggtcccgcccgcgtctttgattcggaagaagagtgcatggcggcgatcatgggcgatcagatcaaggccggtgacgtgatcgtgattcgctacgaaggccctaagggcggccccggcatgcgcgagatgctctcgcccaccagcgcgatcatcggcaaaggcctgggcgacagcgtggggctgatcacagacggacgcttcagcggcggcacctacggcctggtggttggccacgtcgcgcccgaagcctatgtaggcggccccatcgcgctggtgcaggaaggcgacatcatcgagctgaacgccgaaacctgcgagctgacgctgcatgtggacgacgcagaactggagcgccgccgcgccgcgtgggtggccccggaaccgcgctaccggcggggcgtcctggcaaagtacgcgcgactagtaggcagtgcggcgcggggagcggtgaccgattag

SEQ ID NO: 326 - protein, 564 aa, Deinococcus geothermalis
MTDTRTKRRMNWNSHHITQGDERAPNRAMLRAVGFEDGDFDKAIIGVAHAQSNITPCNNGLGELADHITGALREGGAMPQVYGTITVSDGISMGTEGMKCSLVSREVIADSIETVSRGQSHDGLIVVGGCDKNMPGAMIGIARLNIPAIFVYGGTIKPGHYQGKDLTIVSVFEAVGAYGAGKMSREDFEQIEKRACPGNGSCGGMYTANTMSSAFEAMGMSLPYSSTMSAVDAEKAVSAADSARALIRLIEQDIRPLDILTKKAFENAITVVMAVGGSTNAVLHLMAIAHACGVDLTLEDFERIRERTPVFCDLKPSGKYVATDLHEVGGIPRVMKMLLKAGLLHGDCLTVTGQTVAENLADVPDQPDPGQDVILPFDQPLYSQGHLAILRGNLAPEGSVAKISGLRQIKITGPARVFDSEEECMAAIMGDQIKAGDVIVIRYEGPKGGPGMREMLSPTSAIIGKGLGDSVGLITDGRFSGGTYGLVVGHVAPEAYVGGPIALVQEGDIIELNAETCELTLHVDDAELERRRAAWVAPEPRYRRGVLAKYARLVGSAARGAVTD

SEQ ID NO: 327 - DNA, 1695 bp, Polynucleobacter sp.
atgaaacgcctcaatgaacgctctcgcatggttaccgagggggtcgctcgcgcacccaatcgttcgatgtactacgcgatgggttacgaagaaaaggatttcgtaaaaccaatggttggcgttgcaaacggccactccactattaccccttgcaatagtggcttacaaaaattagctgatgccgcagttgaagctctagaagcagctggcgcaaaagcacaagtatttggtacgccaaccgtttctgatggtattggtatgggtactgagggtatgaagtattccctcgtctcacgagaagtgattgctgacagtattgaagtttgtgtaaacggtctttggcaagatggcgtagtagtcattggtggctgcgataaaaatatgcctggtggcatgatggctttagctcgcacgaatgtacctggcatctatgtatatggtggcacgattaagccaggccactttaaaggcaaggaattgaatattgtttctgcatttgaagcagttggtgaatttacctccggtcgattgagtgaagaagatttaaaaggtgttgagcaacacgcctgcccaggtagcggctcttgcggtggaatgtacacggccaataccatgagctcttcatttgaggctttgggtatgagcttgccctactcttctacgatggcaaacgttgacgctgaaaaagtagcgagcgctgccgaatcagcgcgcgtcctcgttgaagccgttaaaaacaacctgcgcccacgcgacatcattaccaagaaatccgttgagaatgcggttagcgtcatcatggcagttggcggttcaaccaatgcagtgttgcatttcttggcgattactagtgccgctgaaattgattggacaattgatgactttgaacggattcgtaagcaagtcccagtcatcgttgatatgaaaccctctggcacttatttagcaactgacttacaccaagctggcggtattccacaagtcatgaagattttgcttgacggtggcctgcttcatggcgattgcatcaccattaccggaaaaactattgctgaagtattaaaagatgttccatcagtgccgcgcgctgatcaaaaagtcattcgcacgctagacaacccactctacaagcaaggtcacttagcgattctgaagggcaatatttctccagaagggtgcgttgccaaaattactggcctcaagaatccatcgattactggcccagctcgagtctttgattctgaagatgatgcgatggctgccatcatggctcagaagatcaaagatggcgacatcgtggtgattcgttacgaaggccctaaaggcggtcctggtatgcgtgaaatgcttgcccctacctctgccctagttggtcaaggtttaggcgagtcagttggcctcatcaccgatggtcgcttctctggtggtacttggggcatggtagttggtcacgttgctcctgaggcctttgtagggggcacaattgccctcatcaacgaaggtgactcagtcacgatagatgctcaccaacttcttattcagctcaacgtcagcgaagaagaaattgctaagcgacgcgcagcttggaaacaacctaagccacgctatacccgcggcttacttgcgaagtatgcaagccttgctagtagtgcgagcaaaggtgctgtaaccgatttgaatttagatttgacctaa

SEQ ID NO: 328 - protein, 564 aa, Polynucleobacter sp.
MKRLNERSRMVTEGVARAPNRSMYYAMGYEEKDFVKPMVGVANGHSTITPCNSGLQKLADAAVEALEAAGAKAQVFGTPTVSDGIGMGTEGMKYSLVSREVIADSIEVCVNGLWQDGVVVIGGCDKNMPGGMMALARTNVPGIYVYGGTIKPGHFKGKELNIVSAFEAVGEFTSGRLSEEDLKGVEQHACPGSGSCGGMYTANTMSSSFEALGMSLPYSSTMANVDAEKVASAAESARVLVEAVKNNLRPRDIITKKSVENAVSVIMAVGGSTNAVLHFLAITSAAEIDWTIDDFERIRKQVPVIVDMKPSGTYLATDLHQAGGIPQVMKILLDGGLLHGDCITITGKTIAEVLKDVPSVPRADQKVIRTLDNPLYKQGHLAILKGNISPEGCVAKITGLKNPSITGPARVFDSEDDAMAAIMAQKIKDGDIVVIRYEGPKGGPGMREMLAPTSALVGQGLGESVGLITDGRFSGGTWGMVVGHVAPEAFVGGTIALINEGDSVTIDAHQLLIQLNVSEEEIAKRRAAWKQPKPRYTRGLLAKYASLASSASKGAVTDLNLDLT

SEQ ID NO: 329 - DNA, 1692 bp, Polynucleobacter necessarius
atgaaacgcctaaatgaacgctcgcgcatggtcacagaaggggtcgcacgcgcacctaatcgttcgatgtattacgcaataggttacgaagaaaaggatttcgtaaagccaatggttggcgttgcgaatggtcactccactatcaccccttgtaatagtggtttacaaaaattagccgatgctgcagtttctgcgcttgaaggtgctggtgcaaaagcacaaatgtttggcaccccaaccgtttccgatggcataggcatgggcacagaaggcatgaagtattcactcgtgtcacgcgaagtgattgctgacagtattgaaacttgtgtaaatggactgtggcaagacggtgtagttgtgattggcggctgcgataaaaatatgccaggcggcatgatggctttagctcgcaccaatgtgcccggcatctatgtatatggcggcacaattaagccaggccactacaaaggtaaagaccttaatatcgtttcagcgtttgaagcagttggtgaatttacctccggcagactcagcgaagaggatttaaaaggtgtagaacaacatgcctgtccgggtagcggctcctgcggtggtatgtataccgccaacacaatgagctcggcctttgaggccttaggcatgagcctcccctactcctcaacgatggcaaacgaagatgcagaaaaagtagcaagcacacatgattctgctgtcgtattggttgaagcgatcaaaaagaacttgcgtccacgcgacatcattaccaagaaatcgattgagaacgctgttagcgtaatcatggctgttggtggatctacaaatgcggtgctgcatttcttggcgattactagcgccgctgaaatcgattggaccattgatgattttgaacgcattcgtaagcgcgttcctgtaatcgtggatatgaaaccatcgggcacctaccttgctaccgatttgcatcaagctggcggcattcctcaagtgatgaagattttgctcgacgacggattgctccacggcgattgcatgactatcactggcaaaacagttgcggaagtgttgaaagatgttccatccgtaccgcgcgccgatcagaaagtgatccgtaccttagataatcctttgtataaacaaggtcacttggcaatcttgaaaggcaatatctcaccagagggttgtgtgaccaagataaccggcctcaaaaatccatcgatcaccggcccagcacgcgtctttgattctgaagatgatgctatggcagccatcatggcacagaagattaaagatggtgacatcgtggtcattcgctatgaaggccctaaaggcggccctggtatgcgcgaaatgcttgcccccacctctgccctagttggtcaaggtttaggcgaatctgtggggcttattaccgatggccgcttctctggtggcacttggggcatggtcgttggccacgtggcaccggaagcttatgtcggtggaaccatcgccctcattcatgagggtgactctgtcacgatcgatgcgcataagctactcattcagctgaatgtagatgatgcagagatcgctaaacgtcgcgcagcctggaagcaacccaagccacgctacacccgcggcttgcttgcaaagtatgccaaacttgctagcaccgcaagcaaaggggcggtgaccgacttaaatttgaatgattag

SEQ ID NO: 330 - protein, 563 aa, Polynucleobacter necessarius
MKRLNERSRMVTEGVARAPNRSMYYAIGYEEKDFVKPMVGVANGHSTITPCNSGLQKLADAAVSALEGAGAKAQMFGTPTVSDGIGMGTEGMKYSLVSREVIADSIETCVNGLWQDGVVVIGGCDKNMPGGMMALARTNVPGIYVYGGTIKPGHYKGKDLNIVSAFEAVGEFTSGRLSEEDLKGVEQHACPGSGSCGGMYTANTMSSAFEALGMSLPYSSTMANEDAEKVASTHDSAVVLVEAIKKNLRPRDIITKKSIENAVSVIMAVGGSTNAVLHFLAITSAAEIDWTIDDFERIRKRVPVIVDMKPSGTYLATDLHQAGGIPQVMKILLDDGLLHGDCMTITGKTVAEVLKDVPSVPRADQKVIRTLDNPLYKQGHLAILKGNISPEGCVTKITGLKNPSITGPARVFDSEDDAMAAIMAQKIKDGDIVVIRYEGPKGGPGMREMLAPTSALVGQGLGESVGLITDGRFSGGTWGMVVGHVAPEAYVGGTIALIHEGDSVTIDAHKLLIQLNVDDAEIAKRRAAWKQPKPRYTRGLLAKYAKLASTASKGAVTDLNLND

SEQ ID NO: 331 - DNA, 1704 bp, Azoarcus sp.
atgtccgaccctacccgtccagcccggatcgatgaacgttcccgcaacgtgaccgaaggcgtgatgcgggcgcccaatcgatcgatgtactacgcgatgggctatcgggaaactgatttcggcaagccgatggttggcgtggcgagcgcacattcgacgatcacgccctgcaacagcgggctgcaaccgctggccgataccgtggccgcggccttgaaggaggccggggccaatccgcaactgttcggtactcccaccgtgtccgacggcatcggcatgggcaccgagggcatgaagtattcgctggtatcgcgggaagtgatcgccgacagcatcgagacctgcgtcaatgggctgtggcaggacggggtcgtcgtgatcggcggatgcgacaagaacatgcccggcggcatgatggcgcttgtccgcaccaacgtgcctggaatctatgtctatggcggcacgatcaaaccggggcattacaagggcagggatctgaacatcgtctcggttttcgaggcggtgggggaattcatcgcggggcagctcgacccggtcgatttcaaggaaatcgaaaagcgcgcctgccccggcagcggctcgtgcggcgggatgtacacggcaaacacgatgagcgccgcgttcgaggcgctcggcatgagcctgccatattcttcgacgatggccaacgaggacgctgagaagctcgcgagcgccgcggagtccgcccgggtgctggtggaggcgatcaaacgcggccttcgcccgcgcgacatcgtcacccgggaggcgatcgagaacgctgtcagcgtgatcatggcgacgggaggctcgaccaacgcggtgctgcactttctggcgattgcccacgcggccgaagtgccgtggacaatcgacgacttcgagcgcattcggcgtcgcgtgccggtcatcgtcgacatgaagccgtccgggcgctacctcgcgaccgatctccatcaggcaggcggcatcccgcaggtgatgaagctgctgctcgacgccgggctgctgcatggcgcgtgcgtcacgatcaccgggcagacgatcgcggaggtcctggagaacgtgccggcggcaccgcgtgccgatcagggcgtcatccggacgctgtccgatccgctgtacgcggagggccatctggcgatcctcaggggcaacctctcgccggaaggctgcgtggcgaagatttcgggcctgaagaatcccgccatcaccggcccggcgcgcgtcttcgactccgaggacgacgcgatggcggcgatcatggcgcgccggatcgtggagggtgacgtcgtggtaatccgctacgagggacccaagggcggccccggcatgcgcgagatgctcgccccgacgtcggcgctcgtcgggcaggggctgggagagtcggtcgggctgatcactgacggccgcttctcgggaggcacctggggcatggtcgtcggccacgtttcccccgaagcgttcgtcggtggcccgattgcgctggttcgcgaaggggactcggtcacgatcgacgcgcaccggcagctcgtccagctgaatgtcggtgatgaagagctcgcgcgccgagccgccgactggacgccgccgtccccgcgctacacccgcggcgtgctggcgaagtttgcgaagttcgccagttccgcgagcaagggcgcggttaccgatctggacttgtag

SEQ ID NO: 332 - protein, 567 aa, Azoarcus sp.
MSDPTRPARIDERSRNVTEGVMRAPNRSMYYAMGYRETDFGKPMVGVASAHSTITPCNSGLQPLADTVAAALKEAGANPQLFGTPTVSDGIGMGTEGMKYSLVSREVIADSIETCVNGLWQDGVVVIGGCDKNMPGGMMALVRTNVPGIYVYGGTIKPGHYKGRDLNIVSVFEAVGEFIAGQLDPVDFKEIEKRACPGSGSCGGMYTANTMSAAFEALGMSLPYSSTMANEDAEKLASAAESARVLVEAIKRGLRPRDIVTREAIENAVSVIMATGGSTNAVLHFLAIAHAAEVPWTIDDFERIRRRVPVIVDMKPSGRYLATDLHQAGGIPQVMKLLLDAGLLHGACVTITGQTIAEVLENVPAAPRADQGVIRTLSDPLYAEGHLAILRGNLSPEGCVAKISGLKNPAITGPARVFDSEDDAMAAIMARRIVEGDVVVIRYEGPKGGPGMREMLAPTSALVGQGLGESVGLITDGRFSGGTWGMVVGHVSPEAFVGGPIALVREGDSVTIDAHRQLVQLNVGDEELARRAADWTPPSPRYTRGVLAKFAKFASSASKGAVTDLDL

SEQ ID NO: 333 - DNA, 1674 bp, Burkholderia phymatum
atgccgtacaaccgtcgttcgaagaacatcacgcaaggcgtcgcgcgttcgccgaaccgctcgatgtattacgcgctcggctaccagaaggcagacttcgacaagccgatgatcggcatcgccaacggccactcgaccatcacgccgtgcaacgcgggcctgcaacgactcgccgacgccgccgtcgaagccgtcaagcgcagcgatgcgaatccgcagaccttcggtacgccgaccatttcggacggcatgtcgatgggcacggagggcatgaagtactcgctcgtgtcgcgcgaagtgatcgccgactgcatcgagacctgcgtgcaggggcaatggatggacggcgtcgtcgtgatcggcggctgcgacaagaacatgccgggcggcatgatcggcctcgcgcgaatgaacgtgccaggcatctacgtgtacggcgggaccatcaagccgggcaactggaaaggcaccgacctgactatcgtgtcgtcgttcgaggcagtgggcgaattcacggcgggccgcatgtcgcaagaagacttcgaaggggtcgaacagaacgcctgcccgagcacgggctcgtgcggcggcatgtacacggccaacacgatgagctcgtcgttcgaagcgctcggtatgtcgctgctgtactcgtcgacaatggcgaacccggatcaggagaaagtggattcggcggccgagtcggcgcgcgtgctggtcgaagccgtcaagcaggatctcaagccgcgcgacatcattacgaagaagtcgatcgaaaacgccgttgcgctgatcatggcgacgggcggctcgacgaacgccgtgctgcactatctggccattgcgcacgcggcggaagtggactggtccatcgaagatttcgagcgcatgcgcaagaaagtgcccgtcatctgcgatctcaagccgtcgggcaagtatgtcgccaccgatctgcacaaggccggcggcatcccgcaggtgctgaagctgctgctcgatgcaggcctgctgcacggcgactgcatcacgatcacgggcaagacgatcgccgaagagctgaaggacgtgccagccaaaccgcgcgcggaccagaaggtgatctatccgatcgacaaggcgctttacagcgaaggccatctcgcgattctcaagggcaacctcgcggaagacggcgcggtcgcgaagatcaccgggctgaagaaccccgtcatcacagggcccgcacgcgtgttcgacgacgagcaaagtgcgatggaagccatcctcgccgaccagatcaaggcaggcgatgtcgtcgtgctgcgctatctcggcccgcaaggcggccccggcatgccggaaatgctggcgccgacctcggcgatcatcggcaagggtctcggcgaatcggtcggtcttatcacggatgggcgcttctcgggcggcacctggggcatggtggtgggtcacgtcgcgccggaagcgttcgtcggcggcacgatcgcactcgtgcaggaaggcgattcgatcaccatcgacgcccacaagctgctgttgcaactgaacgtcgacgacggcgaactgcagcgccgccgcgccgcatggaagcagcccgcgccgcgctatacgcgcggcgtgctggccaagttcgcggcgctcgcgaagccggccaacaagggcgccgtcaccggctga

SEQ ID NO: 334 - protein, 557 aa, Burkholderia phymatum
MPYNRRSKNITQGVARSPNRSMYYALGYQKADFDKPMIGIANGHSTITPCNAGLQRLADAAVEAVKRSDANPQTFGTPTISDGMSMGTEGMKYSLVSREVIADCIETCVQGQWMDGVVVIGGCDKNMPGGMIGLARMNVPGIYVYGGTIKPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIITKKSIENAVALIMATGGSTNAVLHYLAIAHAAEVDWSIEDFERMRKKVPVICDLKPSGKYVATDLHKAGGIPQVLKLLLDAGLLHGDCITITGKTIAEELKDVPAKPRADQKVIYPIDKALYSEGHLAILKGNLAEDGAVAKITGLKNPVITGPARVFDDEQSAMEAILADQIKAGDVVVLRYLGPQGGPGMPEMLAPTSAIIGKGLGESVGLITDGRFSGGTWGMVVGHVAPEAFVGGTIALVQEGDSITIDAHKLLLQLNVDDGELQRRRAAWKQPAPRYTRGVLAKFAALAKPANKGAVTG

SEQ ID NO: 335 - DNA, 1674 bp, Burkholderia xenovorans
atgccatacaaccgtcgttcgaagaacatcacgcaaggtgtagcgcgttcgccgaatcgctcgatgtactacgcgctcggctacgaaaaagccgacttcgacaagccgatgatcggcatcgccaacggtcactcgaccatcacgccgtgcaacgcgggcctgcagcgtctcgccgatgccgcggtcgccgcgatcaaaggcgccgacgcgaacccacagatcttcggcacgccgacgatctcggacggcatgtcgatgggcaccgagggcatgaagtactcgctggtgtcgcgcgaagtgatttccgactgcatcgagacctgcgtgcaaggccagtggatggacggcgtggtcgtgatcggcggctgcgacaagaacatgccgggcggcatgatcggcatgctgcgcaccaacgtgccgagcatctacgtgtatggcgggacgattcgtccgggcaactggaagggcaccgacctgaccatcgtgtcgtcgttcgaggccgtgggcgaattcaccgccggccggatgtcgcaggaagatttcgaaggggtcgaacagaacgcgtgcccatccaccgggtcgtgcggcggcatgtacaccgccaacaccatgagctcgtcgttcgaagcgctcggcatgtcgctgctgtattcgtccacaatggccaatccggatcaggaaaaagtcgactcggccgccgaatcggcacgcgtgctggtcgaagcggtcaagcaggatctcaagccgcgcgacatcgtgacccgcaagtcgatcgaaaacgccgtggccgtgatcatggccaccggcggctcgaccaatgccgtgctgcactttctcgccatcgcgcatgcggccgaagtggagtggagcatcgaggacttcgagcgcatgcgcaagaaggtgccggtgatctgcaacctgaagccgtcgggccagttcgtggcgaccgatctgcacaaggccggcggcattccgcaagtcatgaagatcctgctcgacgcaggtctgttgcacggcgattgcatcacgatcaccggccgaaccctcgcggaagagttgaaggacgtgccggccaggccgcgcgccgatcagcaggtgattttcccgatcgagcaggcgctgtacaaggaaggccatctcgcgatcctcaagggcaacctggccgtggacggcgcggtcgccaagatcaccggcctgaagaatcccgtgatcaccggcccggcgcgcgtgttcgacgacgagcaaagcgcgctggaagcgattctggccgacaggatcgtcgcgggcgacgtggtggtgctgcgctatctcggcccgaagggcggccccggcatgccggagatgctcgcgccgacctcggcgatcatcggcaagggactcggcgagagcgtggggctcatcaccgacgggcgcttctcgggtggcacgtggggcatggtggtcgggcacgtcgcgccggaagccttcgtgggcggcacgatcgcgttcgtgcaggaaggcgactcgatcaccatcgacgcgcacaagctgctgctgcaactgaatatcgacgacgccgaactggagcgacgccgtgccgcatggcagcagccgaagccgcgctacacacgcggcgtgctggcgaagtactccgcattggctctgccggccaataagggcgccgtgacgggctaa

SEQ ID NO: 336 - protein, 557 aa, Burkholderia xenovorans
MPYNRRSKNITQGVARSPNRSMYYALGYEKADFDKPMIGIANGHSTITPCNAGLQRLADAAVAAIKGADANPQIFGTPTISDGMSMGTEGMKYSLVSREVISDCIETCVQGQWMDGVVVIGGCDKNMPGGMIGMLRTNVPSIYVYGGTIRPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIVTRKSIENAVAVIMATGGSTNAVLHFLAIAHAAEVEWSIEDFERMRKKVPVICNLKPSGQFVATDLHKAGGIPQVMKILLDAGLLHGDCITITGRTLAEELKDVPARPRADQQVIFPIEQALYKEGHLAILKGNLAVDGAVAKITGLKNPVITGPARVFDDEQSALEAILADRIVAGDVVVLRYLGPKGGPGMPEMLAPTSAIIGKGLGESVGLITDGRFSGGTWGMVVGHVAPEAFVGGTIAFVQEGDSITIDAHKLLLQLNIDDAELERRRAAWQQPKPRYTRGVLAKYSALALPANKGAVTG

SEQ ID NO: 337 - DNA, 1674 bp, Burkholderia multivorans
atgtcgtacaaccgtcgctcgaagcacatcacgcaaggcgtcgcccgctcgccgaaccgttcgatgtattacgccctcggctatcagaaggaagatttcgacaagccgatgatcggcatcgccaacgggcattcgacgatcacgccgtgcaacgcggggctgcagcgcctgtccgacgcggccgtcgaggcgatcaaggcggccggcgcgaatccgcagatcttcggcacgcccacgatctcggacggcatgtcgatgggcaccgaagggatgaagtactcgctcgtgtcgcgcgaggtaatcgccgactgcatcgagacctgcgtgcagggccaatggatggacggcgtcgtggtagtcggcggctgcgacaagaacatgccgggcgggatgatcgcgctcgcgcggctgaacgtgccgggcatctacgtgtacggcgggacgatccgccccggccactggaaaggcaaggatctgacgatcgtctcggcgttcgaggcggtcggcgaattcacggccgggcgcatgtcggacgaggatttcgagggcatcgagcgcaacgcgtgcccgacgtcgggctcgtgcggcggcatgtacaccgcgaacacgatgagctcgtcgttcgaggcgctcggcatgtcgctgatgtattcgtcgacgatggcgaaccccgatcaggaaaaggtcgattcggcggccgaatcggcgcgtgtgctcgtcgaagcggtgaagcgcgacctgaagccgcgcgacatcatcacgaagcagtcgatcgagaacgcggtgtcgctgatcatggcgaccggcggctcgaccaatgcggtgctgcactatctcgcgatcgcgcatgcggccgaggtcgactggacgatcgacgacttcgagcggatccgcaagcgcgtgccggtgatctgcgacctgaagccgtcgggccagtacgtcgcgaccgacctgcaccgtgcgggcggcattccgcaggtgctgaagatcctgctcgatgcgggcctgctgcacggcgactgcgtcacgatcaccggccgcacgctcgccgaagagctgaaggacgtgccgtccgtgccgcgcgccgatcagcaggtgatcttcccgatcgagcgcgcgctgtacaaggagggccatctcgcgatcctgaagggcaatctcgccgaggacggcgcggtcgcgaagatcaccggcctgaagaacccggtgatcacgggcccggcgcgcgtgttcgacgacgagcaaagcgcgatggacgcgatcctcggcgacaagatccgcgccggcgacgtgctcgtgctgcgctatctcggcccgcaaggcgggcccggcatgccggaaatgctcgcgccgacgtcggcgatcatcggcaaggggctcggcgaatcggtcggcttcatcaccgacggccgcttctccggcggtacgtgggggatggtcgtcggccacgtcgcgcccgaggcgttcgtcggcggcacgatcgcgctcgtgcaggaaggcgactcgatcacgatcgacgcgcataagctgctgctgcagctgaacgtcgacgatgcggaactcgcgcgccgccgcgccgcatggaagcagccggcgccgcgctacacgcgcggcgtgctcgccaagtatgccgcgctcgcacggccggcgaatcggggtgcggtcacggggtga

SEQ ID NO: 338 - protein, 557 aa, Burkholderia multivorans
MSYNRRSKHITQGVARSPNRSMYYALGYQKEDFDKPMIGIANGHSTITPCNAGLQRLSDAAVEAIKAAGANPQIFGTPTISDGMSMGTEGMKYSLVSREVIADCIETCVQGQWMDGVVVVGGCDKNMPGGMIALARLNVPGIYVYGGTIRPGHWKGKDLTIVSAFEAVGEFTAGRMSDEDFEGIERNACPTSGSCGGMYTANTMSSSFEALGMSLMYSSTMANPDQEKVDSAAESARVLVEAVKRDLKPRDIITKQSIENAVSLIMATGGSTNAVLHYLAIAHAAEVDWTIDDFERIRKRVPVICDLKPSGQYVATDLHRAGGIPQVLKILLDAGLLHGDCVTITGRTLAEELKDVPSVPRADQQVIFPIERALYKEGHLAILKGNLAEDGAVAKITGLKNPVITGPARVFDDEQSAMDAILGDKIRAGDVLVLRYLGPQGGPGMPEMLAPTSAIIGKGLGESVGFITDGRFSGGTWGMVVGHVAPEAFVGGTIALVQEGDSITIDAHKLLLQLNVDDAELARRRAAWKQPAPRYTRGVLAKYAALARPANRGAVTG

SEQ ID NO: 339 - DNA, 1686 bp, Burkholderia cenocepacia
atggagctccccatgtcgtacaaccgccgctctaagaacatcacgcaaggcgtggcccgttcgccgaaccgctcgatgtattacgccctcggctaccagaaggacgatttcgataaaccgatggtcggtatcgcgaacggccactcgacgatcacgccgtgcaattccggcctgcagcgcctgtcggacgcggccgtggatgccgtgaaggcggccggcgcgaacccgcagatcttcggcacgccgacgatttcggacggcatgtcgatgggcaccgaagggatgaagtactcgctcgtgtcgcgcgaagtgatcgccgactgcatcgagacctgcgtgcagggccagtggatggacggcgtggtggtggtcggcggctgcgacaagaacatgcccggcggcatgatcgcgctcgcacgcctgaacgtgccgggcatctacgtgtacggcggcacgatccgcccgggcaactggaagggccgcgacctgacgatcgtgtcgtcgttcgaggccgtcggcgaattcaccgcgggccggatgtcgcaggaagacttcgaaggcgtcgagaagaacgcgtgcccgacgtcgggttcgtgcggcggcatgtacaccgcgaacacgatgagttcgtcgttcgaggcgctcgggatgtcgctgctgtattcgtcgacgatggcgaaccccgaccaggaaaaagtcgattcggccgccgaatcggcacgcatgctggtcgaggcggtgaagcgcgacctgaagccgcgcgacatcatcacgaaggaatccatcgagaacgcggtgtcggtgatcatggccaccggcggctcgaccaatgcggtgctgcactatctcgcgatcgcgcacgcggccgaagtcgactggacgatcgacgacttcgagcgcattcgcaagcgcgtgccggtgatctgcgacctgaagccgtcgggacaatacgtcgcgaccgacctgcaccgggccggcgggattccgcaggtgctgaagatcctgctcgatgcagggctgctgcacggcgactgcatgacgatcaccggccgcacgatcgccgacgagctgaaggacgtgccggccgtgccgcgcgcggaccagcatgtgatcttcccgatcgaccgcgcactgtacaaggaaggccacctcgcgatcctgaagggcaatctcgcggaagacggcgcggtcgcgaagatcaccggcctgaagaacccggtgatcacgggcccggcgcgcgtgttcgacgacgaacagagcgcaatggacgcgatcctcggcgaccggattcgcgcgggcgacatcctcgtgctgcgctacctcggcccgcagggtggccccggcatgccggaaatgctcgcgccgacttccgcgatcatcggcaaggggctcggcgaatcggtcggcttcatcacggacggacgcttctcgggcggcacttggggcatggtggtcggccacgtcgcgccggaggcgttcgtcgggggcacgatcgcgctggtgcaggaaggcgattcgatcacgatcgacgcgcaccggctgctgctgcaactgaacgtcgacgaggcggaactcgcacggcgccgtgccgcgtggcgacagccggcgccgcgctatacgcgcggggtgctcgcgaaattcgcggcgctcgcccgaccggcgaaccagggagcggtcacgggttga

SEQ ID NO: 340 - protein, 561 aa, Burkholderia cenocepacia
MELPMSYNRRSKNITQGVARSPNRSMYYALGYQKDDFDKPMVGIANGHSTITPCNSGLQRLSDAAVDAVKAAGANPQIFGTPTISDGMSMGTEGMKYSLVSREVIADCIETCVQGQWMDGVVVVGGCDKNMPGGMIALARLNVPGIYVYGGTIRPGNWKGRDLTIVSSFEAVGEFTAGRMSQEDFEGVEKNACPTSGSCGGMYTANTMSSSFEALGMSLLYSSTMANPDQEKVDSAAESARMLVEAVKRDLKPRDIITKESIENAVSVIMATGGSTNAVLHYLAIAHAAEVDWTIDDFERIRKRVPVICDLKPSGQYVATDLHRAGGIPQVLKILLDAGLLHGDCMTITGRTIADELKDVPAVPRADQHVIFPIDRALYKEGHLAILKGNLAEDGAVAKITGLKNPVITGPARVFDDEQSAMDAILGDRIRAGDILVLRYLGPQGGPGMPEMLAPTSAIIGKGLGESVGFITDGRFSGGTWGMVVGHVAPEAFVGGTIALVQEGDSITIDAHRLLLQLNVDEAELARRRAAWRQPAPRYTRGVLAKFAALARPANQGAVTG

SEQ ID NO: 341 - DNA, 1686 bp, Burkholderia mallei
atggagttccccatgtcgtacaaccgccgctcgaagaacatcacgcaaggcgtggcccgttcgccgaaccgctcgatgtattacgcgctcggctatcagaaggaagatttcgacaagccgatgatcggcatcgcgaacggccactcgacgatcacgccgtgcaacgcgggcctgcagcgtctgtcggacgccgccgtcgcggccgtcaaggacgccggcgcgaatccgcagatcttcggcacgccgacgatctcggacggcatgtcgatgggcaccgaagggatgaagtactcgctcgtgtcgcgcgaggtgatcgccgattgcatcgagacctgcgtgcagggccaatggatggacggcgtcgtcgtcgtgggcggctgcgacaagaacatgccgggcggcatgatcgcgctcgcgcggatcaacgtgccgggcatctacgtgtacggcggcacgatccgccccggccactggaaaggccacgacctgacgatcgtgtcgtcgttcgaggcggtcggcgagttcaccgccggacgcatgtcgcaggaggatttcgaaggggtcgaaaagaacgcgtgcccgacgacgggctcgtgcggcggcatgtataccgcgaacacgatgagctcgtcgttcgaggcgctcggcatgtcgctgctgtactcgtcgacgatggccaatcccgatcaggagaaggtcgattcggcggcggaatcggcgcgcgtgctggtcgaggcggtgaagaaggacctgaagccgcgcgacatcatcacgaagcagtcgatcgagaacgcggtgtcggtcatcatggccacgggcggctcgaccaacgcggtgctccactatctggcgatcgcgcacgcggccgagatcgactggtcgatcgaggatttcgagcgcatcaggaagcgcgtgccggtgatttgcgacctgaagccgtcgggccagtacgtcgcgaccgatctgcacgcggcgggcggcattccgcaggtgatgaagctgctgctcgacgcgggcctgctgcacggcgactgcatgacgatcacgggccgcacgctcgccgaggagctgaaggacgtgccgagcgtgccgcgcgccgatcagaaggtgatccatccgatcgaccaggcgctgtacaaggaaggccacctcgcgatcctgaagggcaacctcgccgaggacggcgcggtcgcgaagatcaccggcctgaagaacccggtcatcaccggcccggcgcgcgtgttcgacgacgagcagagcgcgctcgccgcgatcctcgacgacaggatccgcgcgggcgacgtcgtcgtgctgcgctacctcggcccgcaaggcggcccggggatgcccgagatgctcgcgccgacatcggcgatcatcggcaagggcctcggcgaatcggtcggcctgatcaccgacggccgcttctccggcggcacgtgggggatggtggtcggccacgtcgcgccggaagcgttcgtcggcggcacgatcgcgctcgtgcaggaaggcgattcgatcacgatcgacgcgcacaagctgctgctgcaattgaacgtcgacgacgccgaactcgcgcgccgccgcgccgcatggaagcagccggcgccgcgctacacgcgcggcgtgctcgcgaagtacgcggcgctcgcccgcccggcgaaccagggcgccgtcacgggctga

SEQ ID NO: 342 - protein, 561 aa, Burkholderia mallei
MEFPMSYNRRSKNITQGVARSPNRSMYYALGYQKEDFDKPMIGIANGHSTITPCNAGLQRLSDAAVAAVKDAGANPQIFGTPTISDGMSMGTEGMKYSLVSREVIADCIETCVQGQWMDGVVVVGGCDKNMPGGMIALARINVPGIYVYGGTIRPGHWKGHDLTIVSSFEAVGEFTAGRMSQEDFEGVEKNACPTTGSCGGMYTANTMSSSFEALGMSLLYSSTMANPDQEKVDSAAESARVLVEAVKKDLKPRDIITKQSIENAVSVIMATGGSTNAVLHYLAIAHAAEIDWSIEDFERIRKRVPVICDLKPSGQYVATDLHAAGGIPQVMKLLLDAGLLHGDCMTITGRTLAEELKDVPSVPRADQKVIHPIDQALYKEGHLAILKGNLAEDGAVAKITGLKNPVITGPARVFDDEQSALAAILDDRIRAGDVVVLRYLGPQGGPGMPEMLAPTSAIIGKGLGESVGLITDGRFSGGTWGMVVGHVAPEAFVGGTIALVQEGDSITIDAHKLLLQLNVDDAELARRRAAWKQPAPRYTRGVLAKYAALARPANQGAVTG

SEQ ID NO: 343 - DNA, 1674 bp, Ralstonia eutropha
atggcattcaacaaacgctcccgcaacatcacgcaaggtgtggcgcgttccccgaaccgctcgatgtactacgccctgggctaccagaaggaagacttcgacaagcccatggtcggcatcgccaacggccactcgacgatcacgccgtgcaacgccggcctgcagcgcctggccgacgccgcgatcgacgccgtgaaggcctcggacgccaatccgcaggtattcggcacgccgacgatctccgacggcatgtcgatgggcaccgagggcatgaagtactcgctgatctcgcgcgaagtcattgccgactgcatcgagaccgccgcccagggccagtggatggacggcgtggtggtgatcggcggctgcgacaagaacatgccgggcggcatgatcgcgctcgcgcgcaccaatgtgccgggcatctacgtctatggcggcaccatcaagcccggcaactggaagggcaaggacctgaccatcgtgtcgtcgttcgaggccgtgggcgaattcaccgccggccgcatgagcgaagaagatttcgagggcgtggaaaggaacgcttgtccgtcgaccggatcgtgcggcggcatgtacaccgccaatacgatgagctcgtcgttcgaggcgcttgggatgtcgctgctgtattcgtcgacgatggccaaccccgatcaggaaaaggtcgatagcgctgccgaatcggcgcgcgtgctggtcgaggcgatcaagaaggacatcaagccgcgcgacatcatcacgcgcaagtcgatcgaaaacgccgtcgcgctgatcatggccaccggtggctcgaccaacgcggtgctgcactacctggccattgcgcactcggccgaagtcgaatggaccatcgacgatttcgagcgcatccgtcgcaaggtgcctgtgatctgcaacctgaagccgtcgggccagtacgtggccaccgacctgcacaaggcgggcggcatcccgcaggtcatgaagatcctgctgaaggccggactgctgcatggcgactgcctgaccatcacaggccgcacgctggctgaagagctggaacacgtgccggaccagccgcgggccgaccaggacgtgatcatgccaatcgagaaggcgctctatgcggaggggcatctggcgatcctgaagggcaatctcgccgaggaaggcgcggtggccaagatcaccggcctgaagaatccggtcatcaccgggccggcgcgggtgttcgaggatgaacagagcgcgatggaggcgatcctggccgacaagatcaatgcgggggatgtgctggtgctgcgctatcttgggcccaagggcgggcccgggatgccggaaatgctggcgcctacgtcagccattattggcaaggggttgggagagtcggtgggcttcatcaccgatggccggttctccgggggcacctgggggatggtcgtcggccatgtcgcgccggaagcgtatgtaggcggcaatattgcgctcgtgcgggaaggggattcgatcacgatcgatgcgcacaagctggtgttgcaggtgaatgtgtcggatgaggagttggctcgccgccgggctgagtggaaacaacctgttgcgcgttatacacggggggtattggccaagtttgctcgactggcgtcgacggccagtaagggggcggtgacggattga

SEQ ID NO: 344 - protein, 557 aa, Ralstonia eutropha
MAFNKRSRNITQGVARSPNRSMYYALGYQKEDFDKPMVGIANGHSTITPCNAGLQRLADAAIDAVKASDANPQVFGTPTISDGMSMGTEGMKYSLISREVIADCIETAAQGQWMDGVVVIGGCDKNMPGGMIALARTNVPGIYVYGGTIKPGNWKGKDLTIVSSFEAVGEFTAGRMSEEDFEGVERNACPSTGSCGGMYTANTMSSSFEALGMSLLYSSTMANPDQEKVDSAAESARVLVEAIKKDIKPRDIITRKSIENAVALIMATGGSTNAVLHYLAIAHSAEVEWTIDDFERIRRKVPVICNLKPSGQYVATDLHKAGGIPQVMKILLKAGLLHGDCLTITGRTLAEELEHVPDQPRADQDVIMPIEKALYAEGHLAILKGNLAEEGAVAKITGLKNPVITGPARVFEDEQSAMEAILADKINAGDVLVLRYLGPKGGPGMPEMLAPTSAIIGKGLGESVGFITDGRFSGGTWGMVVGHVAPEAYVGGNIALVREGDSITIDAHKLVLQVNVSDEELARRRAEWKQPVARYTRGVLAKFARLASTASKGAVTD

SEQ ID NO: 345 - DNA, 1674 bp, Ralstonia metallidurans
atggcttacaacaaacgttcccagcacatcacgcaaggcgtggcgcgctcccccaaccgttcgatgtactacgcgctcggctacaagaaggaagacttcgacaagccgatggtgggtatcgccaacggccactcgacgatcaccccctgcaacgccggcctgcagcgcctggcggacgcggccgtggatgcgatcaaggcctcggacgccaacccgcagatcttcggcacgccgacgatctccgacggcatgtcgatgggcaccgagggcatgaagtactcgctgatctcgcgtgaagtcattgccgactgcatcgaaaccgctgcccagggccagtggatggacggcgtggtcgtgatcggcggctgcgacaagaacatgcccggcggcatgatcgcactggcgcgcaccaacgtgccgggcatctacgtctacggcggcaccatccgcccgggtaactggaagggcaaggacctgaccatcgtgtcgtcgttcgaggccgtgggcgaattcaccgccggccgcatgagcgaggaagacttcgagggcgtggagaagaacgcctgcccgagcaccggctcgtgcggtggcatgtacaccgccaacacaatgagctcgtcgttcgaggcgctgggcatgtcgctgctgaattcgtcgacgatggccaacccggaccaggaaaaggtggacagcgccgccgaatcggcccgcgtgctggtggaagccatcaagaaggacatcaagccgcgcgacatcatcacgcgcaaatcgatcgagaacgccgtgacgctgatcatggccacgggcggttccaccaacgcggtactgcattacctggccatcgcccactcggccgaagtggaatggaccatcgacgatttcgagcgcatccgccgccgcgtgccggtgatctgcaacctgaagccgtcgggcgcctacgtggccaccgacctgcaccgcgccggtggcattccgcaagtgatgaagatcctgctgaacgccggtctgctgcatggcgactgcctgacgatcacgggccgcacgctggccgaggagctcgagcacgttcccaatgagccgcgtaccgaccaggacgtgatcctgccgatctcgcaggccctgtacaagcaaggccacctggccatcctgaagggcaacctcgccgaggaaggcgcagtggccaaaatcaccggcctgaagaacccggtcatcaccggcccggcccgcgtgttcgaggacgaacagagcgccatggaagcgatcctggcggacaagatcaacgctggcgacatcctggtgctgcgctaccttggcccgaagggcggcccgggcatgcctgaaatgctggcgccgacttcggcgatcatcggcaagggtctcggcgaatcggttggtttcatcaccgacggccgcttctcggggggcacctggggcatggtggttggccacgttgcgccggaagcccatgtgggcggtacgattgcactggttcaggaaggcgactcgatcacgatcgacgcgcaccagctgctgctgcaactgaatgtggccgacgacgagctggcccgccgccgcgctgcctggaaacagccggcgccgcgctacacgcgcggcgtactggcgaagttcgcgaggctggcctccacggccagcaagggcgccgtgacggactga

SEQ ID NO: 346 - protein, 557 aa, Ralstonia metallidurans
MAYNKRSQHITQGVARSPNRSMYYALGYKKEDFDKPMVGIANGHSTITPCNAGLQRLADAAVDAIKASDANPQIFGTPTISDGMSMGTEGMKYSLISREVIADCIETAAQGQWMDGVVVIGGCDKNMPGGMIALARTNVPGIYVYGGTIRPGNWKGKDLTIVSSFEAVGEFTAGRMSEEDFEGVEKNACPSTGSCGGMYTANTMSSSFEALGMSLLNSSTMANPDQEKVDSAAESARVLVEAIKKDIKPRDIITRKSIENAVTLIMATGGSTNAVLHYLAIAHSAEVEWTIDDFERIRRRVPVICNLKPSGAYVATDLHRAGGIPQVMKILLNAGLLHGDCLTITGRTLAEELEHVPNEPRTDQDVILPISQALYKQGHLAILKGNLAEEGAVAKITGLKNPVITGPARVFEDEQSAMEAILADKINAGDILVLRYLGPKGGPGMPEMLAPTSAIIGKGLGESVGFITDGRFSGGTWGMVVGHVAPEAHVGGTIALVQEGDSITIDAHQLLLQLNVADDELARRRAAWKQPAPRYTRGVLAKFARLASTASKGAVTD

SEQ ID NO: 347 - DNA, 1674 bp, Ralstonia solanacearum
atgccagacaacaagcgttcccagcacatcacccagggcgtggcacgctcgcccaaccgctcgatgtactacgcgctgggctaccagaaagaagacttcaacaatccgatgatcggcgtggccaacggccattcgaccatcacgccgtgcaactcgggcctgcagaaactggccgacgcggccgtggccgccgtcaaggcatcgaacgccaacccgcagatcttcggcacgcccaccatttccgacggcatgtcgatgggcaccgagggcatgaagtattcgctgatctcgcgcgaggtcatcgccgactgcatcgagacctgcgcacaaggccagtggatggacggcgtggtcgtgatcggcggctgcgacaagaacatgcccggcggcatgatcgcgctggcacgcaccaacgtgccgggcatctacgtgtacggcggcaccatccggccggggcactggaagggcaaggacctgaccatcgtgtcgtcgttcgaggccgtgggcgagttcaccgccggccgcatgagcgacgaagacttcgagggcatcgagaagaacgcctgcccgtcgagcggctcgtgcggcggcatgtacaccgccaacacgatgagctcgtcgttcgaggcgctgggcatgtcgctgctgtattcgtcgaccatggccaaccccgaccaggagaaggtcgacagcgccgccgaatcggcccgcgtgctggtcgaggccgtgcgccgcgacctcaagccgcgcgacatcatcacgcgcaagtcgatcgagaacgccgtggccgtcatcatggcgaccggcggctcgaccaacgccgtgctgcactacctggccatcgcccatgccgccggcgtggaatggaccatcgatgacttcgagcgcgtgcgccagcgcgtgcccgtgatctgcaacctgaagccgtcgggccagtatgtcgccaccgacctgcaccgcgcgggcggcatcccgcaggtgatgaagatcctgctgaacgcgggcctgctgcacggcgactgcatcaccatcaccggcaagacgctggccgaggaactcgccaacgtgcccgaccagccgcgcgcggaccaggacgtgatcctgccgctcgacaaggcgctctaccagcagggccacctcgccatcctcaagggcaacttggccgaggaaggcgccgtggcgaagatcaccggcctgaagaacccggtcatcaccggcccggcgcgcgtgttcgacgatgagcagagcgcgatggaagccatcctgggcgacaaaatcaacgccggcgacgtgctggtgctgcgctacctcggtccgaagggcggcccgggcatgccggaaatgctggccccgacgtcggccatcatcggcaagggcctgggcgaatcggtcggcttcatcaccgatggacgcttctcgggcggcacctggggcatggtggtcggccacgtcgcgccggaagccttcgtgggcggcaccatcgccctggtgcaggaaggcgattcgatcaccatcgacgcgcaccagcgcgtgctgcagctgaacgtgccggaagacgaactggcccgccgccgcgccgcgtggcagcagccggcaccgcgctatacgcgcggcgtgctcgccaagttcgctcagttggcgtcgacggccagcaagggcgccgtgaccggctga

SEQ ID NO: 348 - protein, 557 aa, Ralstonia solanacearum
MPDNKRSQHITQGVARSPNRSMYYALGYQKEDFNNPMIGVANGHSTITPCNSGLQKLADAAVAAVKASNANPQIFGTPTISDGMSMGTEGMKYSLISREVIADCIETCAQGQWMDGVVVIGGCDKNMPGGMIALARTNVPGIYVYGGTIRPGHWKGKDLTIVSSFEAVGEFTAGRMSDEDFEGIEKNACPSSGSCGGMYTANTMSSSFEALGMSLLYSSTMANPDQEKVDSAAESARVLVEAVRRDLKPRDIITRKSIENAVAVIMATGGSTNAVLHYLAIAHAAGVEWTIDDFERVRQRVPVICNLKPSGQYVATDLHRAGGIPQVMKILLNAGLLHGDCITITGKTLAEELANVPDQPRADQDVILPLDKALYQQGHLAILKGNLAEEGAVAKITGLKNPVITGPARVFDDEQSAMEAILGDKINAGDVLVLRYLGPKGGPGMPEMLAPTSAIIGKGLGESVGFITDGRFSGGTWGMVVGHVAPEAFVGGTIALVQEGDSITIDAHQRVLQLNVPEDELARRRAAWQQPAPRYTRGVLAKFAQLASTASKGAVTG

SEQ ID NO: 349 - DNA, 1674 bp, Ralstonia pickettii
atgccagacaacaagcgttcccagcacatcactcagggcgtggcgcgctcgcccaaccgctcgatgtactacgcgctgggctacacaaaagacgacttcaacaatccgatgatcggtgtggccaacggccattcgaccatcacgccatgcaactcgggcctgcagaagctggccgatgccgccgtggctgcaataaaggacgcccgcgcgaatccgcagatcttcggcacgcccaccatttccgatggcatgtcgatgggcacggaaggcatgaagttctcgctgatctcgcgcgaagtgattgccgactgcatcgagacctgcgtcaacggccaatggatggacggtgtggtcgtcatcggcggctgcgacaagaacatgccgggcggcatgatcgccctggcgcgcacgaatgtgccgggcatctacgtgtacggcggcaccatcaagccggggcactggaagggcaaggacctgaccatcgtctcgtcgttcgaggccgtgggcgaattcaccgccggccgcatgagcgaggaagacttcgagggcatcgaaaaaaacgcctgcccgtcgagcggttcgtgcggcggcatgtacacggccaacacgatgagttcgtcgtttgaagcgctaggcatgtcgttgctgtattcatcgacgatggccaatcccgatcaggagaaggtcgacagcgccgccgaatccgctcgcgtgttggttgatgccgtgcgccgcgacctgaagccgcgcgacatcatcacgcgcaagtccatcgagaacgctgtcgccgtcatcatggcaaccggtggctcgaccaacgccgtgctgcactacctggccatcgctcacgctgcggaagtggaatggacgatcgacgacttcgagcgggtgcgccagcgcgtgcccgtcatctgcaacctcaagccgtcgggccagtacgtggccaccgacctgcacgaggccggcggcatcccgcaggtgatgaagctgctgctcaacgccggcctgctgcatggcgattgcatcaccatcaccggcaagacgctggcggaagaactcgcccacgtgcccgaccagccgcgcgctgatcagaacgtgatcctgccgattgacaaggcgctctacaaggaaggccacctcgccatcctgaagggcaatctggccgaagaaggcgccgtggcgaagatcaccgggctgaagaatcccgtcatcaccggcccggcccgcgtgttcgaggacgagcaaagtgcgatgagcgcgatcctgggcgaccagatcaaggccggcgatattctggtgctgcgctatctggggccgaagggcggccccggcatgccggagatgctggccccgacctcggccatcatcggcaagggcctgggcgagtcagtcggcttcattaccgacggacgcttctcgggcggtacgtggggcatggtggtcggccacgtcgcaccggaagcctacgtgggaggcacgattggattggtgcacgaaggggattcgatcaccatcgacgcgcaccagcggctgctgcaattgaacgtgccggacgacgagcttgcccgccgccgcgccgcgtggaagcaacctgcgccgcgctatacgcgtggcgtgctggcgaagtttgcaaaactggcagcaacggccagcaagggtgcggtaacggactga

SEQ ID NO: 350 - protein, 557 aa, Ralstonia pickettii
MPDNKRSQHITQGVARSPNRSMYYALGYTKDDFNNPMIGVANGHSTITPCNSGLQKLADAAVAAIKDARANPQIFGTPTISDGMSMGTEGMKFSLISREVIADCIETCVNGQWMDGVVVIGGCDKNMPGGMIALARTNVPGIYVYGGTIKPGHWKGKDLTIVSSFEAVGEFTAGRMSEEDFEGIEKNACPSSGSCGGMYTANTMSSSFEALGMSLLYSSTMANPDQEKVDSAAESARVLVDAVRRDLKPRDIITRKSIENAVAVIMATGGSTNAVLHYLAIAHAAEVEWTIDDFERVRQRVPVICNLKPSGQYVATDLHEAGGIPQVMKLLLNAGLLHGDCITITGKTLAEELAHVPDQPRADQNVILPIDKALYKEGHLAILKGNLAEEGAVAKITGLKNPVITGPARVFEDEQSAMSAILGDQIKAGDILVLRYLGPKGGPGMPEMLAPTSAIIGKGLGESVGFITDGRFSGGTWGMVVGHVAPEAYVGGTIGLVHEGDSITIDAHQRLLQLNVPDDELARRRAAWKQPAPRYTRGVLAKFAKLAATASKGAVTD

SEQ ID NO: 351 - DNA, 1689 bp, Limnobacter sp.
atgagcatcaatcgacgttccaagaacattacccagggcgtggcccgttcgcccaaccgcgcgatgtatttcgccatgggttacaaagacgaagacttcaataaccccatgattggcattgccaatggccattccacgatcacgccttgcaacagcggcttgcagcctttggcagatgcggctgtgaaagcagtgaaagaggctggtggcaatccacaaattttcggcacccccaccatctccgatggcatgagcatgggcaccgaaggcatgaagtattcactggtcagccgcgaggtcatcgcggactgcatcgaaactgcggtacagggccagtggatggacggcgtgttggtgatcggcggctgcgacaagaacatgcccggcggcatgatcggcatggcccgcatgaacgtgccaggcatttacgtttatggcggcactatcaagccggggcgttacaaaggcaaagacctgaccattgtgtctgccttcgaagccgtgggcgaattcacggctggccgcatgagcgaggaagacttcaagggtatagagaagaacgcctgcccgagttccggttcctgtggtggcatgtacaccgccaacaccatgagctcggcattcgaagctttgggcatgagcctgccctactccagcaccatgtcgaacattgacgcagagaaagtcacttcaactgaagagtccgctcgcgtcttgatcgaagcggttcgcaacgacttgaagccccgcgacatcatcaccaagaagtcgattgaaaatgctgtggccgtgctgatggccaccggtggttccaccaacgcggtactgcacttcctggccattgcaaaagcagcagatgtggcctggagctacgaagactttgaacgcgtgcgcttgcgcacaccagtcatttgcaacctgaagccttctggccaatacgttgccactgacctgcacgatgccggtggtattccacaagtcatgaaaattttgttggatgcgggcctgttgcatggcgattgcatcaccatcactggcaaaaccattgcagaaaccctggccgatattccttcagtgccccgcgcggatcaaaacgtgatcatgccgatcgaaaaagccctgtacaagcaaggccacttggcgattctgaaaggcaacctggcacccgaaggtgctgtggccaagatcacaggcctcaaaaaccctgtaattaccggaccagccaaggtttttgacgacgagcaaagcgcgatggacgcaattttgggcgacaagatcaaagacggcgacgtgattattcttcgctacttgggccccaaaggcggtccaggcatgccggaaatgttggccccaacctcggcaattattggcaagggcttgggagaaacagtcggcctgatcaccgacggccgcttttccggtggcacctggggtatggtggtcggccacgttgcgccagaggcctacgttggcggcccgatcgcgctgatcaaggaaggtgactccatcacgatggacgcacatcagaaattgttacagatcaacgtgagcgaggaagaactggcgaagcgtcgtgaaagttgggtaaaacccaagccacgctacaccactggtgtgctggccaaattcgcagccttggccagtagcgccagcaagggtgcagtcaccgatggcgatctcgacctctaa

SEQ ID NO: 352 - protein, 562 aa, Limnobacter sp.
MSINRRSKNITQGVARSPNRAMYFAMGYKDEDFNNPMIGIANGHSTITPCNSGLQPLADAAVKAVKEAGGNPQIFGTPTISDGMSMGTEGMKYSLVSREVIADCIETAVQGQWMDGVLVIGGCDKNMPGGMIGMARMNVPGIYVYGGTIKPGRYKGKDLTIVSAFEAVGEFTAGRMSEEDFKGIEKNACPSSGSCGGMYTANTMSSAFEALGMSLPYSSTMSNIDAEKVTSTEESARVLIEAVRNDLKPRDIITKKSIENAVAVLMATGGSTNAVLHFLAIAKAADVAWSYEDFERVRLRTPVICNLKPSGQYVATDLHDAGGIPQVMKILLDAGLLHGDCITITGKTIAETLADIPSVPRADQNVIMPIEKALYKQGHLAILKGNLAPEGAVAKITGLKNPVITGPAKVFDDEQSAMDAILGDKIKDGDVIILRYLGPKGGPGMPEMLAPTSAIIGKGLGETVGLITDGRFSGGTWGMVVGHVAPEAYVGGPIALIKEGDSITMDAHQKLLQINVSEEELAKRRESWVKPKPRYTTGVLAKFAALASSASKGAVTDGDLDL

SEQ ID NO: 353 - DNA, 1674 bp, Herminiimonas arsenicoxydans
atggcattcaatcgccgctcgaaaaacatcacgcaaggcgtgtcccgcagtcctaaccgttccatgtattacgccatgggttacgaaaaggccgatttcgacaagcctatggtcggcatcgccaacggtcactcgacgattacgccatgtaactccggcctgcaaaaactggccgatatcgcgatcaagaccatcaaggatgcaggcggcaatccgcaagtgttcggtacgccgacgatttccgacggcatgtccatgggcaccgaaggcatgaagtattcgctgatttcgcgcgaagtcattgccgactgtatcgaaaccgcagtcaacggccaatggatggatggcgtgctggtcatcggcggctgcgacaagaatatgccgggcggcatgatcgccatgttgcgcaccaacgtgcctagtatttatgtctacggcggcaccatcaagccggggcactggaaaggcaaagacctgaccatcgtttccgcgtttgaagcggtcggcgaattcactgccggccgcatgtcacaagaagattttgacggcatcgaacgcaatgcctgcccatcatccggttcctgcggcggcatgtatacagccaataccatgtcgtcctcgttcgaggcgctgggcctggccttgccttactcgtcgacgatggccaatcctgacgatgaaaaagtcggctccgcagcggaatccgcgcgcgtgctgatcgaagcaatcaagaaggatctgaagccgcgcgacatcgtgacacgcaaggctatcgaaaacgcagtggccgtcatcatggcaaccggcggttcgaccaatgccgtgctgcacttcctggcgattgcgcacgctgcagaaatcgactggaccatcgacgacttcgaacgcatgcgcaaaaaagtccctgtcatctgcgatctgaaaccatccggcaaatacgtggcaaccgatctgcataaggccggcggcattccgcaagtgatgaaggtgttgctcgacgccggcttgttgcacggtgattgcatgacgatcaccggccagaccgttgcagaagcgctggcgcacatcccgtcggtaccaagtgccgaccaggacgtgatccacaccatcgacaaggctttgtacgcacaaggtcaccttgcaatcctgaagggcaatctgtcgcctgaaggttgcgtggcaaaaatcaccggtctgaaaaatcctgtcatcaccggacctgcacgcgtatttgacgacgaatactcggcaatggacgccatcatggcgaaccagatcaaggccggcgacgtactcgtcatgcgctacctcggacctaaaggcggcccgggcatgccggaaatgctggcaccgacttccgcactggtcggtcagggtctgggtgagtcagtcggcttgattaccgatggccgtttctccggcggtacctggggcatggtggttggccacgtttcgccggaagcgtttgtcggcggtaccatcggtctggtggaagaaggcgattccgtcaccatcgatgcgcgtcaattgctgattcagttgaacgtatcggaagaggaaatcgcacgccgtcgcgccaactggaagcagcctgcaccgcgttacacacgtggcgtgctggcaaaatatgcagctctggcatcgacggcaagcaaaggcgctgtcaccggctga

SEQ ID NO: 354 - protein, 557 aa, Herminiimonas arsenicoxydans
MAFNRRSKNITQGVSRSPNRSMYYAMGYEKADFDKPMVGIANGHSTITPCNSGLQKLADIAIKTIKDAGGNPQVFGTPTISDGMSMGTEGMKYSLISREVIADCIETAVNGQWMDGVLVIGGCDKNMPGGMIAMLRTNVPSIYVYGGTIKPGHWKGKDLTIVSAFEAVGEFTAGRMSQEDFDGIERNACPSSGSCGGMYTANTMSSSFEALGLALPYSSTMANPDDEKVGSAAESARVLIEAIKKDLKPRDIVTRKAIENAVAVIMATGGSTNAVLHFLAIAHAAEIDWTIDDFERMRKKVPVICDLKPSGKYVATDLHKAGGIPQVMKVLLDAGLLHGDCMTITGQTVAEALAHIPSVPSADQDVIHTIDKALYAQGHLAILKGNLSPEGCVAKITGLKNPVITGPARVFDDEYSAMDAIMANQIKAGDVLVMRYLGPKGGPGMPEMLAPTSALVGQGLGESVGLITDGRFSGGTWGMVVGHVSPEAFVGGTIGLVEEGDSVTIDARQLLIQLNVSEEEIARRRANWKQPAPRYTRGVLAKYAALASTASKGAVTG

SEQ ID NO: 355 - DNA, 1785 bp, Bordetella parapertussis
atgtccgataataaccggcgagcgtgttgttccgtagcgctgccttccgacagcgatctggccggcccggcatgggcctacgcacctggagacaagaccatgtccgacaacaatcgttcccgtcacattaccgagggcgtggcgcgcgcgcccaatcgggccatgtactacgcgctgggctacaccgaggcggatttccagaatccgatgatcggcgtggccaacggacattccacgatcactccatgcaacagcgggctgcagcgcctggccgacgcggcgatcgaggccatccgcgtctcccgcgccaacccccaggtgttcggcacgccgacgatttccgatggcatgtccatgggcaccgaaggaatgaagtattcgctggtgttgcgcgaggtcatcgccgactgcatcgagaccgccgcgcaggggcagtggatggatggcgtggtggtcatcggcggatgcgacaagaacatgcccggcggcatgatggcgctcgcgcgcatgaatgtgcccggcatctacgtgtatggcggcaccatcaagcccggccactacaagggcaaggacctgaccatcgtatcggtgttcgaagccgtcggcgaatacaccatgggccgcatggacgaaaccgacttcaaggccatcgagcaatgcgccatccccgggtcgggttcctgcggcggcatgtacacggccaacaccatgagctcggccttcgaggccatggggatgagcctgcctcattccagcaccatggccaacgaggaccaggagaaagtcgcgtcggcggcggaatcggcgcgcgtgctggtcgaggcggtgcggcgccagctgcggccgcgcgacatcatcacccgcgcttccatcgagaacgccgtggcggtgatcatggccacgggcggctcgaccaacgccgtgctgcacttcctcgccatcgcccacgcggcggaagtgccgtggaacatcgacgacttcgagcgcatccgcaagcgcgtgccggtcatctgcgatctcaagccgtccggcaagtacgtggcgaccgacctgcatcgcgccggcggcatcccacaagtgatgaagatcctgctgaacgccggcctgttgcatggcgattgcatcaccatcaccggcaagaccgtggccgagacgctggcgaacgtacccgatgcgccgccgcccgggcaggacgtcatcatgcccatcgaacgcgcgttctacccgcaggggcacctggcgatactcaagggcaatctttcgccggaaggctgcgtggccaagatcaccgggttgaagaatccggtcattaccggcccggcgcgcgtgttcgattccgaagacgatgccatgtccgccatcatggaccgccgcatccgcgatggcgatgtggtggtgatccgctacgagggccccaagggcggtccaggcatgcgcgagatgctcgcgcccacttccgcgctggtcggccaggggttgggcgaaaccgtcggcctgatcaccgacgggcggttttccggcggcacctggggcatggtggtcgggcacgtggcgcccgaggcgttcgtcggcgggccgatcgcgctgattcgcgagggcgattcggttaccatcgatgcccatcagctgctgctgcagctcaacatcagcgatgaggaaatggcggctcgtcgcaaggcttgggcccagcccaagccgcgctatgtgcgcggcgtgcttgccaagttcggcaagctggcctgtaccgccagccgtggggcagtaaccgatgcatttgaagagtag

SEQ ID NO: 356 - protein, 594 aa, Bordetella parapertussis
MSDNNRRACCSVALPSDSDLAGPAWAYAPGDKTMSDNNRSRHITEGVARAPNRAMYYALGYTEADFQNPMIGVANGHSTITPCNSGLQRLADAAIEAIRVSRANPQVFGTPTISDGMSMGTEGMKYSLVLREVIADCIETAAQGQWMDGVVVIGGCDKNMPGGMMALARMNVPGIYVYGGTIKPGHYKGKDLTIVSVFEAVGEYTMGRMDETDFKAIEQCAIPGSGSCGGMYTANTMSSAFEAMGMSLPHSSTMANEDQEKVASAAESARVLVEAVRRQLRPRDIITRASIENAVAVIMATGGSTNAVLHFLAIAHAAEVPWNIDDFERIRKRVPVICDLKPSGKYVATDLHRAGGIPQVMKILLNAGLLHGDCITITGKTVAETLANVPDAPPPGQDVIMPIERAFYPQGHLAILKGNLSPEGCVAKITGLKNPVITGPARVFDSEDDAMSAIMDRRIRDGDVVVIRYEGPKGGPGMREMLAPTSALVGQGLGETVGLITDGRFSGGTWGMVVGHVAPEAFVGGPIALIREGDSVTIDAHQLLLQLNISDEEMAARRKAWAQPKPRYVRGVLAKFGKLACTASRGAVTDAFEE

SEQ ID NO: 357 - DNA, 1686 bp, Bordetella petrii
atgcccagcaacgaacgttcacgccacatcacgcaaggcgtcgcccgcgcgcccaaccgggccatgtattacgcgctgggctaccaggaagccgatttcgacaaccccatgatcggcgtggccaacggccattccaccatcaccccctgcaacagcggcctgcagcggctggccgacgcggccatcgatgccgtgcgcgcggcccgcgccaatccgcaggtgttcggcacccccaccatatccgacggcatgtcgatgggcaccgagggcatgaaatactcgctggtgtcgcgcgaagtcattgccgactgtatcgagaccgccgtgcagggccagtggatggacggcgtcgtggtcatcggcggctgcgacaagaacatgcccggcggcatgatcgcgctggcccgcatgaacgtgccaggcatctacgtgtatggcggcaccatcaagccgggccgctataaagggcaagatctcactatcgtgtccgtgttcgaagccgtcggtgagtacaccatggggcgcatggacggcgaagatttccgccagatcgaaaaatgcgccattcccggctcgggctcgtgcggcggcatgtacaccgccaacaccatgagttcggccttcgaagccatgggcatgagcctgccgtattccagcaccatggccaacgaagacgacgaaaaaatcgcctcggccgccgagtccgcccgcgtgctggtcgatgccgtgcggcgcgacgtgcggccgcgcgacatcatcacgcgcgaatccatcgaaaacgccgtgtcggtcatcatggccacgggcggctccaccaatgccgtgctccatttcctggccatcgcccacgccgccgaagttcaatggaccatcgacgacttcgagcgcatccgccggcgcgtgccggtcatctgcgacctcaaaccttcgggccgatacgtggccaccgatctgcaccgcgccggcggcgtcccgcaagtcatgaagctgctgctcgctgccggcttgctgcatgggcattgcatgaccatcaccggcaagaccatcgccgaaacgctcgccgacgtgcccgccgagccgccggccggccaggatgtcatccggcctatcggccgcgcgctgtacccgcagggccatctggccatcctcaagggcaacctgtcgcccgagggctgcgtggccaagatcacgggcctgaagaatcccgtcatcaccggcccggcgcgcgtgttcgattcagaagacgacgccatggccgccatcatggaacggcgcattcgcgctggcgacgtggtggtcatccgctacgaagggcccaagggcggtcccggcatgcgcgaaatgctggcgcccacctcggcgctggtggggcagggcctgggcgaaagcgtcggcctcattaccgatggccgcttctcgggcggcacctggggcatggtcgtgggccatgtcgcgcccgaggcctatgtgggcggccccattgccctgatccgcgaaggcgattcggttaccatcgacgctcaccaattgttgttgcagctcaatatttctgacgacgaaatggcggcgcgccgcaaggcctgggtccagccccggccgcggtacacgcgcggcgtgcttgccaagttcggcaagctggccggcaccgccagtcgcggggcagttaccgatgcatttgaagcatag

SEQ ID NO: 358 - protein, 561 aa, Bordetella petrii
MPSNERSRHITQGVARAPNRAMYYALGYQEADFDNPMIGVANGHSTITPCNSGLQRLADAAIDAVRAARANPQVFGTPTISDGMSMGTEGMKYSLVSREVIADCIETAVQGQWMDGVVVIGGCDKNMPGGMIALARMNVPGIYVYGGTIKPGRYKGQDLTIVSVFEAVGEYTMGRMDGEDFRQIEKCAIPGSGSCGGMYTANTMSSAFEAMGMSLPYSSTMANEDDEKIASAAESARVLVDAVRRDVRPRDIITRESIENAVSVIMATGGSTNAVLHFLAIAHAAEVQWTIDDFERIRRRVPVICDLKPSGRYVATDLHRAGGVPQVMKLLLAAGLLHGHCMTITGKTIAETLADVPAEPPAGQDVIRPIGRALYPQGHLAILKGNLSPEGCVAKITGLKNPVITGPARVFDSEDDAMAAIMERRIRAGDVVVIRYEGPKGGPGMREMLAPTSALVGQGLGESVGLITDGRFSGGTWGMVVGHVAPEAYVGGPIALIREGDSVTIDAHQLLLQLNISDDEMAARRKAWVQPRPRYTRGVLAKFGKLAGTASRGAVTDAFEA

SEQ ID NO: 359 - DNA, 1695 bp, Polaromonas sp.
atggaaaccaagaccattcagctcaacccccgcagcaaaaacatcaccgaaggcaaatcgcgcgcgcccaaccgctcgatgtactacgccatgggctatgaagaggccgacttcaagaagcccatgattggtgtggccaacgggcacagcaccatcaccccctgcaacagcggcctgcaaaagctggcggacgcggccattgccggcattgaagaagccggcggcaacgcccaggtgttcggcacgcccaccatctcggacggcatggccatgggcaccgagggcatgaagtactcgctggtcagccgcgaagtgatctccgactgcatcgaaacctgcgtgcagggccagtggatggacggcgtgctggtgatcggcggctgcgacaagaacatgcccggcggcctgatgggcatgctgcgcgccaacgtgccggccatctacgtctatggcggtaccattttgccgggcagctacaagggcaaagacctcaacatcgtcagcgtgtttgaagccgtcggcgaaaacgcagcaggccgcatgagcgatgaagacctgctgcaaatcgagcgccgcgccattcccggcaccggtagctgcggcggcatgtacacggccaacaccatgtccagcgccttcgaggcgctcggcatttcgctgccctactccagcaccatggccaatccgcacgacgagaaaatgaactcggccagggagtccgccaaggtcctggtcgaagccatcaagaaagacatcaagccgcgcgatctcgtcacgaagaaagccattgaaaacgccgtggcagtgatcatggccacgggcggctccaccaatgccgtgctgcacttcctggcgattgcgcatgccgccggcgtggactggacaatcgacgacttcgaacgcgtgcgccaaagaacgccggtgctgtgcgacctgaagccgtccggcaagtacctggccgtggacctgcaccgcgccggcggcattccgcaggtcatgaagatgctgctggcggccggcctgctgcatggcgactgcctgacgatcaccggccaaaccattgccgaggtgctgaaggatgtgcccgaagcgccgcgcgccgaccaggacgtgattcgccccatcagcaaccccatgtacgcccagggccacctggccatcctgaagggcaacctctcgcctgaaggctgcgtggccaaaatcaccggcctgaaaaacccggtcatgacgggcccggcccgcgtatttgacgacgagcagtcggcgctggccgccatcctggccggcaagatcaaggcgggcgacgtgatggtgctgcgttacctcggccccaagggcggtcccggcatgcctgaaatgctggcgcctaccggtgcgctgattggcgccggcctgggcgaaagcgtgggcctgatcaccgacggccgcttctccggcggcacctggggcatggtagtcggccatgtggcccccgaagcggccgccggcggcaatatcgcattcatcaacgaaggcgactccatcaccattgactcaaaacagttgctgctgcaactgaacatcagcgacgcggagctggaaaaacgcaaggtcggctggaaagcaccggcaccgcgctacaaccgcggcgtgcaggccaagtttgccttcaacgcgtcgagtgccagcaagggtgcggtgctggacgactattga

SEQ ID NO: 360 - protein, 564 aa, Polaromonas sp.
METKTIQLNPRSKNITEGKSRAPNRSMYYAMGYEEADFKKPMIGVANGHSTITPCNSGLQKLADAAIAGIEEAGGNAQVFGTPTISDGMAMGTEGMKYSLVSREVISDCIETCVQGQWMDGVLVIGGCDKNMPGGLMGMLRANVPAIYVYGGTILPGSYKGKDLNIVSVFEAVGENAAGRMSDEDLLQIERRAIPGTGSCGGMYTANTMSSAFEALGISLPYSSTMANPHDEKMNSARESAKVLVEAIKKDIKPRDLVTKKAIENAVAVIMATGGSTNAVLHFLAIAHAAGVDWTIDDFERVRQRTPVLCDLKPSGKYLAVDLHRAGGIPQVMKMLLAAGLLHGDCLTITGQTIAEVLKDVPEAPRADQDVIRPISNPMYAQGHLAILKGNLSPEGCVAKITGLKNPVMTGPARVFDDEQSALAAILAGKIKAGDVMVLRYLGPKGGPGMPEMLAPTGALIGAGLGESVGLITDGRFSGGTWGMVVGHVAPEAAAGGNIAFINEGDSITIDSKQLLLQLNISDAELEKRKVGWKAPAPRYNRGVQAKFAFNASSASKGAVLDDY

SEQ ID NO: 361 - DNA, 1695 bp, Polaromonas naphthalenivorans
atggaaaccaaagtcatcgccatcaaccgccgctcggccaacatcaccgagggcaagtcgcgcgcgcccaaccgctccatgtactacgccatgggctacgaggaaagcgatttcaagaaacccatgatcggcgtggccaacggccacagcaccatcacgccgtgcaacagcggcctgcaaaagctggcggacgcggcgattgacgcgattgaggaagccggcggcaatgcgcaggtgttcggcacgccgacgatttcggacggcatggccatgggcaccgaaggcatgaagtattcgctggtcagccgcgaagtcatttcggactgcatcgaaacctgcgtgcagggccagtggatggacggcgtgctggtggtcggcggctgcgacaagaacatgcccggcggcctgatgggcatgctgcgcgccaacgtgccggcgatttttgtctatggcggcacgatcttgccaggccattaccagggcaaagacctgaacatcgtcagcgtgttcgaagccgtcggtgaaaacgccgccggccgcatgagcgacgaagacctgctgcagattgagcgtcgcgccattcccggcaccggcagctgcggcggcatgtacaccgccaacaccatgtccagcgccttcgaggccctgggcatttcgctgccctactccagcaccatggccaatccgcatgacgaaaagctgaactcggcgaaggaatcggcccgggtgctgatcgaagcggtcaagaaagacatcaagccgcgcgacatcgtcaccaagaaatccattgaaaacgccgtggccgtcatcatggccaccggcggctcgaccaatgccgtgctgcatttcctggccatcgcccatgcggccggcgtcgaatggacgattgacgacttcgagcgcgtgcgccagaaaaccccggtgctgtgcaacctgaaaccctcgggccagtacctggcggtggacctgcaccaggccggcggcattccgcaggtcatgaaaatgctgctggtcgccggcctgctgcatggcgactgcatcaccatttcgggccagaccattgccgaagtgcttgcggacgtgcccgatgcgccgcgcgccggccaggacgtgatccgccccatcgaccagccgatgtatgcgcagggccacctggccatcctcaagggcaacctctcgcccgaaggctgcgtggccaagatcaccggcttgaagaacccggtcatgaccggcccggcccgggtgtttgaggacgagcagtccggcctgaaggcgattctggacggcaagatcgtggccggtgacgtgatggtgctgcgctacctcggccccaagggcggtcccggcatgcctgaaatgctggccccgaccggcgcgctgattggcgccggcctgggcgagagcgtcggcctgatcaccgacgggcgcttttccggcggcacctggggcatggtggtcggccatgtggcgccggaagcggcggccggcggcaatatcgccttcatcgaggaaggcgactcgatcacgattgacgccaatcagctgctgctgcaactgaacatcagcgacgccgagcttgaaagccgcaaggtcggctggacggccccggccccgcgttacacccgtggcgtgcaggccaagttcgccttcaatgcctccagcgccagcaagggcgcggtgcttgatgactattga

SEQ ID NO: 362 - protein, 564 aa, Polaromonas naphthalenivorans
METKVIAINRRSANITEGKSRAPNRSMYYAMGYEESDFKKPMIGVANGHSTITPCNSGLQKLADAAIDAIEEAGGNAQVFGTPTISDGMAMGTEGMKYSLVSREVISDCIETCVQGQWMDGVLVVGGCDKNMPGGLMGMLRANVPAIFVYGGTILPGHYQGKDLNIVSVFEAVGENAAGRMSDEDLLQIERRAIPGTGSCGGMYTANTMSSAFEALGISLPYSSTMANPHDEKLNSAKESARVLIEAVKKDIKPRDIVTKKSIENAVAVIMATGGSTNAVLHFLAIAHAAGVEWTIDDFERVRQKTPVLCNLKPSGQYLAVDLHQAGGIPQVMKMLLVAGLLHGDCITISGQTIAEVLADVPDAPRAGQDVIRPIDQPMYAQGHLAILKGNLSPEGCVAKITGLKNPVMTGPARVFEDEQSGLKAILDGKIVAGDVMVLRYLGPKGGPGMPEMLAPTGALIGAGLGESVGLITDGRFSGGTWGMVVGHVAPEAAAGGNIAFIEEGDSITIDANQLLLQLNISDAELESRKVGWTAPAPRYTRGVQAKFAFNASSASKGAVLDDY

SEQ ID NO: 363 - DNA, 1695 bp, Rhodoferax ferrireducens
atggacatcaaaccagtcatcctgaacccacgcagcaaaaacatcaccgagggcaaatcgcgggcgcccaatcgctccatgtactacgccatgggctacgaggccgacgacttcaagaagcccatgatcggtgtcgccaacggccacagcaccatcacaccgtgcaactccggcctgcaaaagctggccgatgccgccattgccgcgattgaagaagccggcggcaacgcccaggtgttcggcacccccaccatttccgacggcatgtcgatgggcaccgagggcatgaagtattcgctggtcagccgcgaagtaatttccgactgtattgagacctgcgtgcagggccagtggatggacggtgtgctggtgatcggcggttgcgacaaaaacatgcccggcggcctgatgggcatgctgcgcgccaatgtgcccgcgatttatgtctacggcggcaccattttgccgggccattacaagggccaggacctcaacatcgtgagcgtgttcgaggccgtgggcgagaacgccgcaggtcgcatgagcgacgaagatctgttggagattgagcgccgcgccatccctggccccggctcttgcggcggcatgtacaccgccaacaccatgagttcggcctttgaggcactgggcatctccctggtctactcgtccaccatggccaatccgcatgacgagaagctgaattcggcccaagaatcagccaaggtgctgattgaagccatcaagaacgacctgaagccgcgtgacatcgtgacccgcaaatcgattgagaacgcgattgccgttgtgatggcgattggcggctcgaccaacgcggtgctgcatttcctggcgattgcccatgccgcaggcgtggagtggacgattgacgactttgagcgtgtacgccaaaaaaccccggtgttgtgcgacctcaaaccgagcggcaagtacctggcggtggacctgcaccgcgccggtggcattccgcaagtgatgaagatgctgctaagcgctggcctgctgcacggcgactgcatcaccatcaccggccagaccgtggctgaagtgttgaaagacgtgccggatgcaccacgggcagaccaaaacgtgattcggccgatgaacaaaccgatgtatgcccagggccatctggccattctgaagggcaacctggccccggaaggctgcgtcgccaagatcaccggcctgaaaaacccggtcatgaccggcccggcacgcgtctttgaggacgaacaatcggccttggccgcgattctggccaacaagattgtggccggcgatgtcatggtgctgcgctacctcggccccaaaggcggccccggcatgcccgaaatgctggccccgaccggcgcgctggtcggccagggtttgggcgaatcagtcggcctgatcaccgacggccgtttctccggtggcacctggggcatggtggtcggtcacgtggcaccggaagcggctgccggcggcctgattgctttgattgaagaaggcgactcgatcaccatcgacgcgcaccagttgctgctgcaactcaacgtcagcgacgacatcattgccaaacgccgtagcgtgtggacggccccgcagccgcgctacacacgcggcgtgcaggccaagtttgcctttaacgcatccaccgccagcaagggtgcggtgctggacaactactga

SEQ ID NO: 364 - protein, 564 aa, Rhodoferax ferrireducens
MDIKPVILNPRSKNITEGKSRAPNRSMYYAMGYEADDFKKPMIGVANGHSTITPCNSGLQKLADAAIAAIEEAGGNAQVFGTPTISDGMSMGTEGMKYSLVSREVISDCIETCVQGQWMDGVLVIGGCDKNMPGGLMGMLRANVPAIYVYGGTILPGHYKGQDLNIVSVFEAVGENAAGRMSDEDLLEIERRAIPGPGSCGGMYTANTMSSAFEALGISLVYSSTMANPHDEKLNSAQESAKVLIEAIKNDLKPRDIVTRKSIENAIAVVMAIGGSTNAVLHFLAIAHAAGVEWTIDDFERVRQKTPVLCDLKPSGKYLAVDLHRAGGIPQVMKMLLSAGLLHGDCITITGQTVAEVLKDVPDAPRADQNVIRPMNKPMYAQGHLAILKGNLAPEGCVAKITGLKNPVMTGPARVFEDEQSALAAILANKIVAGDVMVLRYLGPKGGPGMPEMLAPTGALVGQGLGESVGLITDGRFSGGTWGMVVGHVAPEAAAGGLIALIEEGDSITIDAHQLLLQLNVSDDIIAKRRSVWTAPQPRYTRGVQAKFAFNASTASKGAVLDNY

SEQ ID NO: 365 - DNA, 1707 bp, Verminephrobacter eiseniae
atggcagacaacaagacgaccacgatcgagcctatcaaccgccgcagcgcgaacatcacacagggcaagtcgcgcgcacccaaccgctccatgtactacgccatgggctacgtggagggcgacttcgtcaagccgatggtcggcgtggccaatggccacagcaccatcacgccttgcaacagcgggctgcaaaaactgaccgatgccgccatcgagggcatcgaggaggccggcggcaatgcccaggtgttcggcacgccgaccatctcggacggcatggccatgggcaccgaaggcatgaagtacagcctggtcagccgtgaagtcatcagcgactgcatagaaacctgcgtcagcggccagtggctggacggcgtgctggtggtcggcggctgcgacaaaaacatgcccggcggcctgatgggcatgttgcgcgccaacgtgcccgcaatctatgtgtacggcggcaccatcctgcccggccactaccaggggcgggaactgaatatcgtcagcgtgttcgaggcggtgggcgaaaacgccgccggcaagctgagcgaccacgacctcagggagatcgaaaagcgcgccatccccggcaccggctcctgcggcggcatgtataccgccaacaccatgtccagcgcgttcgaggccctgggcatcagcctgccctactcgtcgaccatggccaacccgcatgacgagaagacgaactcggccaaggcatcggccaaggtgctgatcgaggccatccgcaacgacctcaagccgcgcgacatcgtgaccaggaaggccatcgagaatgcagtggccgtgatcatggccaccggcggctcgaccaacgccgtgctgcatttcctggcgatcgcccatgcggcaggcgtgccgtggagcatcgacgacttcgagcgcgtgcgccagaagacccccgtgctgtgcgacctcaagcccagcggcaaatacctggccgtggacctgcaccgcgcgggcggcatcccgcaggtgatgaagctgctgctcaacgccggcctgctgcatggcgactgcatcaccatcgagggcaagacgatggcccaagtgctcaaggatgtgcccgatcggccgcgcgcagaccagaacgtgatccgccccatcgaccagcccctgtacgcgcagggccacctggccatcctcaagggcaacctcagccccgaaggggccgtggccaagatcaccggcctgaagaacccggtcatcaccggcccggcgcgcgtgttcgacgacgagcaatctgcgctgcaggcgatactggacggcaagatccaggccggcgacgtgatggtgctgcgctacctggggcccaagggcggccccggcatgcctgaaatgctggcccccaccggcgcgctgatcggcgccggcctgggagaaagcgtgggcctgatcaccgacgggcgcttttccggcggcacctggggcatggtcgtcggccatgtggcgcccgaggccgccgcaggcggcaccatcgctttcgtgcatgaaggcgacagcatcaccatcgacgcccgccaactgctgctgcaattgaatgtggctgaggcagaaatcgcccggcgccgtgcccggtggacggcccccgctgcgcgctacacacgcggcgtgcaggccaagttcgccttcaacgcatcgagcgccagccaaggcgcggtgctcgacgcatactga

SEQ ID NO: 366 - protein, 568 aa, Verminephrobacter eiseniae
MADNKTTTIEPINRRSANITQGKSRAPNRSMYYAMGYVEGDFVKPMVGVANGHSTITPCNSGLQKLTDAAIEGIEEAGGNAQVFGTPTISDGMAMGTEGMKYSLVSREVISDCIETCVSGQWLDGVLVVGGCDKNMPGGLMGMLRANVPAIYVYGGTILPGHYQGRELNIVSVFEAVGENAAGKLSDHDLREIEKRAIPGTGSCGGMYTANTMSSAFEALGISLPYSSTMANPHDEKTNSAKASAKVLIEAIRNDLKPRDIVTRKAIENAVAVIMATGGSTNAVLHFLAIAHAAGVPWSIDDFERVRQKTPVLCDLKPSGKYLAVDLHRAGGIPQVMKLLLNAGLLHGDCITIEGKTMAQVLKDVPDRPRADQNVIRPIDQPLYAQGHLAILKGNLSPEGAVAKITGLKNPVITGPARVFDDEQSALQAILDGKIQAGDVMVLRYLGPKGGPGMPEMLAPTGALIGAGLGESVGLITDGRFSGGTWGMVVGHVAPEAAAGGTIAFVHEGDSITIDARQLLLQLNVAEAEIARRRARWTAPAARYTRGVQAKFAFNASSASQGAVLDAY

SEQ ID NO: 367 - DNA, 1695 bp, Acidovorax sp.
atgaccgacccgctgccgctgaaccgccgctccgcccacatcacccagggcaaggcgcgcgcgcccaaccgctccatgttctacggcatgggctaccaagagggtgacttcgccaagcccatggtgggcgtggccaacgggcacagcaccatcacgccctgcaacagcggcctgcaacgcctggccgacgcggccatcgcaggcatcgaggaagcgggcggcaacgcccaggtcttcggcacgcccaccatcagcgacggcatggccatgggtaccgagggcatgaagtacagcctggtgagccgcgaggtgattgccgactgcgtcgagacctgcgtgcagggccagtggatggacggcgtggtcgtcatcggcggctgcgacaagaacatgcccggcggcctgatgggcatgctgcgcgccaacgtgccggccatctacgtgtatggcggcaccatcctgccgggccgctggcaggggcaagacctgaacatcgtgagcgtgttcgaagccgtgggccagaacgccgcgggcaggatgaccgaccaggagctgaaggacatcgagcagcacgccatcccgggcacgggctcgtgcggcggcatgtacacggccaacaccatgtcctcggccttcgaggcgctgggcatgagcctgccctactcctccaccatggccaatccgcacgacgagaaaatgaactcggcccgcgaatccgcccgggtgctgatcgaggccatccgcaaggacttgaagccacgcgacatcgtcacgcgcaaggccatcgagaacgccgtggccgtgatcatggccacgggcggctccaccaacgcggtgctgcacttcctggcgatcgcgcacgcggcgggtgtggagtggtccatcgacgacttcgagcgcatgcgcaagaaggtcccagtgatctgcgacctcaagcccagcggccggtacctggccgtcgacctgcaccgcgcgggcggcattccccaggtgatgaaggtgctgctgaacgccggcctgttgcacggcgactgcatgaccatcaccggtaaaaccatcgccgaaaccctggccgacgtacccgacgcgccacggccggaccaggacgtgattcgcccgatcgacaaggcgctgtaccgcgaggggcacctcgccatcctcaagggcaacctgagtcccgagggcgccgtggccaagatcaccgggctgaagaaccccgtcatcaccgggcccgcgcgtgtgttcgacgacgagcagtcggcgctgcaggccatcctggacggcaggatcgtcgcgggcgacgtgatggtgttgcgctacctcggccccaagggtggcccgggcatgccggagatgctggcccccacgggcgcgctgatcggtgcgggcctgggcgagagcgtgggcctgatcaccgacgggcgcttctcgggcggcacctggggcatggtggtgggccacgtcgcgcccgaggccgctgcggggggcactattgcgctggtgcatgagggcgacacgatcaccatcgacgcccaccaactgctgctgcaactgcacgtggacgacgccacgctggcacagcgccgcgccgcctggcagccacccacgccgcgctacatgcggggcgtgcaggccaagtttgccttcaacgcctccagcgccagcaagggtgcggtgctggatgacttttcatga

SEQ ID NO: 368 - protein, 564 aa, Acidovorax sp.
MTDPLPLNRRSAHITQGKARAPNRSMFYGMGYQEGDFAKPMVGVANGHSTITPCNSGLQRLADAAIAGIEEAGGNAQVFGTPTISDGMAMGTEGMKYSLVSREVIADCVETCVQGQWMDGVVVIGGCDKNMPGGLMGMLRANVPAIYVYGGTILPGRWQGQDLNIVSVFEAVGQNAAGRMTDQELKDIEQHAIPGTGSCGGMYTANTMSSAFEALGMSLPYSSTMANPHDEKMNSARESARVLIEAIRKDLKPRDIVTRKAIENAVAVIMATGGSTNAVLHFLAIAHAAGVEWSIDDFERMRKKVPVICDLKPSGRYLAVDLHRAGGIPQVMKVLLNAGLLHGDCMTITGKTIAETLADVPDAPRPDQDVIRPIDKALYREGHLAILKGNLSPEGAVAKITGLKNPVITGPARVFDDEQSALQAILDGRIVAGDVMVLRYLGPKGGPGMPEMLAPTGALIGAGLGESVGLITDGRFSGGTWGMVVGHVAPEAAAGGTIALVHEGDTITIDAHQLLLQLHVDDATLAQRRAAWQPPTPRYMRGVQAKFAFNASSASKGAVLDDFS

SEQ ID NO: 369 - DNA, 1695 bp, Delftia acidovorans
atgaccccgccgaaccagatcaaccgccgaagctcccacatcaccgaaggcaaggcgcgcgcagccaaccgctccatgttctacggcatgggctacaaggaagaggatttcaagaagcccatggtcggcgtggccaacggccacagcacgatcacgccgtgcaactccggcctgcaaaggctggcggacgcggccatcgcaggcatcgaggaagccggcggcaacgcgcaggtgttcggcacgccgaccatctcggacggcatgtccatgggcacggaaggcatgaagtactcgctggtcagccgcgaggtgatcgccgactgcatagagacctgcgtgggcggccagtggatggacggcgtgctagtggtcggcggctgcgacaagaacatgccgggcggcatgatgggcatgctgcgcgccaatgtgccggccatctacgtctacggcggcaccatcctgcccggcaggtggaaaggccgggacctgaacatcgtcagcgtgttcgaggccgtcggcgaaaacgccgcgggaaagatcagcgaccaggagctcaaggacatcgagcagcacgccattcccggcacgggctcgtgcggcggcatgtacaccgccaacaccatgtcgagcgcgttcgaggcgctgggcatgagcctgccctactcctccaccatggccaatccccatgatgaaaaggaaaactcggccaaggaatccgccagggtgctgatcgaggccatcaagatggacctcaagccgcgcgatatcgtgacgcgcaagtccatcgagaacgcggtctcggtgatcatggcgaccgggggctccaccaatgccgtgctgcactttcttgcgatcgcccatgcggccggcgtgccctggtccatcgacgacttcgagcgcatccgccagcgggtgccggtgctgtgcgatctcaagcccagcggcagatacctggcggtggacctgcaccaggcgggcggcatcccgcaggtcatgaagatcctgctgaatgcgggcctgctgcacggcgactgcatcaccatctcgggccagaccattgcgcagaccctggctggcgtgcctgacgaaccaccgaacccgcagatcatccgccccctctcggatgcactctatccgcagggccacctggccattctcaagggcaacctgagcccggaaggcgcggtggccaagatcacgggcctgaagaacccggtcatcaccggcccggcacgcgtgttcgacgatgagcaatcggcactggcggccatcctcgacggcaggatacaggccggcgatgtgatggtgctgcgctacctgggccccaagggcggccccggcatgccggaaatgctggcccccacgggcgccctgatcggcgccggcctgggcgagagcgtgggcctgatcaccgatggccgcttctccggcggcacctggggcatggtggtcggccacgtggcgccggaagcggccgtgggcggcaccatcgcgctggtgcacgagggcgactcgatcaccatcgacgcgcacgcattgcggctgcagctgaacgtgcccgaagacgtgctcgcccagcgccgcgcggcatggaaggcccccgcgccccgctacacgcggggcgtgcaggccaagttcgctttcaacgcatcgagcgccagctcgggcgcggtgctggacaacttcgccatctga

SEQ ID NO: 370 - protein, 564 aa, Delftia acidovorans
MTPPNQINRRSSHITEGKARAANRSMFYGMGYKEEDFKKPMVGVANGHSTITPCNSGLQRLADAAIAGIEEAGGNAQVFGTPTISDGMSMGTEGMKYSLVSREVIADCIETCVGGQWMDGVLVVGGCDKNMPGGMMGMLRANVPAIYVYGGTILPGRWKGRDLNIVSVFEAVGENAAGKISDQELKDIEQHAIPGTGSCGGMYTANTMSSAFEALGMSLPYSSTMANPHDEKENSAKESARVLIEAIKMDLKPRDIVTRKSIENAVSVIMATGGSTNAVLHFLAIAHAAGVPWSIDDFERIRQRVPVLCDLKPSGRYLAVDLHQAGGIPQVMKILLNAGLLHGDCITISGQTIAQTLAGVPDEPPNPQIIRPLSDALYPQGHLAILKGNLSPEGAVAKITGLKNPVITGPARVFDDEQSALAAILDGRIQAGDVMVLRYLGPKGGPGMPEMLAPTGALIGAGLGESVGLITDGRFSGGTWGMVVGHVAPEAAVGGTIALVHEGDSITIDAHALRLQLNVPEDVLAQRRAAWKAPAPRYTRGVQAKFAFNASSASSGAVLDNFAI

SEQ ID NO: 371 - DNA, 1683 bp, Methylibium petroleiphilum
atgagcatcaaccgccgttcgaagaacatcaccgaaggcgtggcccgcgcacccaaccgctcgatgtactacgcgatgggctaccaggaggccgacttcaagaagccgatgatcggcgtggcgaacggccactcgaccatcacgccctgcaactcgggcctgcagaagctggccgacgccgcggtcgagggcatcgaggcggccggcggcaatgcacagatcttcggcacccccaccatcagcgacggcatggcgatgggcaccgagggcatgaagtactcgctggtctcgcgcgaggtcatcgccgactgcgtggaaacctgcgtcggcggccagtggatggacggcgtgctggtggtcggcggctgcgacaagaacatgccgggcggcatgatgggcatgctgcgcgccaacgtgcccgcgatctacgtctacggcggcaccatcctgccgggaaagtacaagggccaggatctcaacatcgtcagcgtgttcgaggccgtcggccagttcaccgcgggcaacatgagcgaggaagacttctgccagatcgagcgacgcgcgatcccgggcagtggctcctgcgggggcatgtacaccgccaacaccatgagttcggccttcgaggccctgggcatgagcctgccgttcgcctccacgatggccaatgtcgaggacccgatcgtcgcgcacaccaaggaagcggcgcgcgtgctggtcgaggcagtgaaggccgacctcaagccgcgtgacatcgtcacacgcaagagcatcgagaacgcggtcgcggtgatcatggccaccggcggctcgaccaatgcggtgctgcacttcctggccatcgcgcacgccgccggcgtcgagtggacgatcgacgacttcgagcgcgtgcgccgcaaggtgccggtgctgtgcgacctcaaacccagcggcaggtacctggcgatcgacctgcaccgcgccggcggcatcccgcaggtgatgaagacgctgctcgccgccgggctgatccacggcgactgcatcaccatcaccggaaggaccgtggccgagaacctggccgacatccccgatgcgccgcgcgccgaccaggacgtgatccgcccgatcacgaagccgatgtacgagcaaggccacctggccatcctgaagggcaacctgtcgcctgagggcgccgtggccaagatcaccggcctgaagaatcccagcatcactggcccggcgcgcgtgttcgacgacgagcagtcggcgctggccgccatcatggccaagcagatccaggccggcgacgtgatggtgctgcgctacctgggcccgatggggggcccgggcatgcccgagatgctggcgccgaccggtgcgctgatcggccaagggctgggcgaatcggtggggctcatcaccgacggccgcttctccggcggcacctggggcatggtggtcggccacgtggcacctgaggccgcggccggcggcacgatcgcgctggtgcaggaaggcgactcgatcaccatcgatgcgcacacgctggtgctcaacctcaacgtgagcgaggccgagatcgcaaagcgtcgcgccgcctggaaggcaccggcgccgcgctacacacgcggcgtgctggccaagttcgcgaagaacgcgtcaagcgccagcagcggcgcggtattggaccgcttcgagtag

SEQ ID NO: 372 - protein, 560 aa, Methylibium petroleiphilum
MSINRRSKNITEGVARAPNRSMYYAMGYQEADFKKPMIGVANGHSTITPCNSGLQKLADAAVEGIEAAGGNAQIFGTPTISDGMAMGTEGMKYSLVSREVIADCVETCVGGQWMDGVLVVGGCDKNMPGGMMGMLRANVPAIYVYGGTILPGKYKGQDLNIVSVFEAVGQFTAGNMSEEDFCQIERRAIPGSGSCGGMYTANTMSSAFEALGMSLPFASTMANVEDPIVAHTKEAARVLVEAVKADLKPRDIVTRKSIENAVAVIMATGGSTNAVLHFLAIAHAAGVEWTIDDFERVRRKVPVLCDLKPSGRYLAIDLHRAGGIPQVMKTLLAAGLIHGDCITITGRTVAENLADIPDAPRADQDVIRPITKPMYEQGHLAILKGNLSPEGAVAKITGLKNPSITGPARVFDDEQSALAAIMAKQIQAGDVMVLRYLGPMGGPGMPEMLAPTGALIGQGLGESVGLITDGRFSGGTWGMVVGHVAPEAAAGGTIALVQEGDSITIDAHTLVLNLNVSEAEIAKRRAAWKAPAPRYTRGVLAKFAKNASSASSGAVLDRFE

SEQ ID NO: 373 - DNA, 1683 bp, unknown
  gamma proteobacterium KT 71
atggcgctcaatcgtcgctccaaaaacatcaccgagggcgtccaacgtgcgcccaatcgctccatgtactacggcatgggctatgaggagggcgattttaggaagcccatggtgggcattgccaactctcactcgacgatcacgccctgtaatgcgggactccagcccctggctgatgccgctcaggaaggcctgaaagaagccggggccaatcctcaggtgtttggcacgccgaccatatccgacggcatgtccatgggtaccgagggcatgaagtactccctggtatcccgggaagttatcgctgactgcatcgaaacctgcgtgggcggtcagtggatggacggcgtgctggtgatcggtggctgtgacaaaaacatgcccggcggcatgatgggcatgctccgcgcaaacgtcccctcgatttttgtatacggcgggaccattcttcccgggcgtcacaatggtcaggatctgaacatcgtcagcgtgtttgaggcggtcggtgagcatgcggcggggcgtatcagggacgaggatttactggctatcgaacgcaatgcgattccgggaacgggctcctgcggcggtatgtataccgcaaacaccatgagctcggcctttgaggccctgggcatgagccttccttattcctcgaccatggcaaacgtcgagtccgaaatcaaagaatcagccaaggcgagcgcgctggctctggtggaggcgattcgcctggatcttaagcccagggatattgtgacccgcgagtccctggaaaatgccgttgcggtgattatggcgaccgggggatcgaccaatgcggtattacactttctggcgattgcccacgccgcggagattgactggagtatcgacgactttgagcgaatccgacaaaaagtaccggtgctctgcgatctcaagcccagcggggagtatctggccattgatctgcaccgtgctggcggcattccccaggtgatgaaaattctcttggacgggggcttgctccacggcgactgcatgaccgtaacgggcaagactattgcggaatccctggcggatgtgccttcgacgcccgtggaccccaaggtcattcgtcctctggataaccccatgtatgccaaggggcatctggcgattcttcgcggcaatctcgccgaagagggcgccgtagccaaaatcacgggtctgaaaaaccccgtgatcacgggacctgcgaaagtgtttgatgatgaacagtcggcccttgatgccattctcgcgggcaaggtcaaagccggtgacgtggtggtactgcggtatctagggccccagggcggaccgggtatgcccgagatgctggcacccaccagtgctctggtggggcagggtctcggggagtccgtaggcctgattaccgacggccgattttccgggggcacctgggggatggttgtggggcatgtggcacccgaagcctatgcgggtggtctcattgccctgatagaggagggggactccatcaccatcgatgcccataccctgagtctggaactcaatgtcgacgacaaagaaattgctcgccggcgcggcgcctgggtaaagcccgagccacgctacacccggggcgtcctcgccaagtttgcaaaaaatgcagccaccgcaagccgcggcgcggtgctggatctgtatgaggactaa

SEQ ID NO: 374 - protein, 560 aa, unknown
  gamma proteobacterium KT 71
MALNRRSKNITEGVQRAPNRSMYYGMGYEEGDFRKPMVGIANSHSTITPCNAGLQPLADAAQEGLKEAGANPQVFGTPTISDGMSMGTEGMKYSLVSREVIADCIETCVGGQWMDGVLVIGGCDKNMPGGMMGMLRANVPSIFVYGGTILPGRHNGQDLNIVSVFEAVGEHAAGRIRDEDLLAIERNAIPGTGSCGGMYTANTMSSAFEALGMSLPYSSTMANVESEIKESAKASALALVEAIRLDLKPRDIVTRESLENAVAVIMATGGSTNAVLHFLAIAHAAEIDWSIDDFERIRQKVPVLCDLKPSGEYLAIDLHRAGGIPQVMKILLDGGLLHGDCMTVTGKTIAESLADVPSTPVDPKVIRPLDNPMYAKGHLAILRGNLAEEGAVAKITGLKNPVITGPAKVFDDEQSALDAILAGKVKAGDVVVLRYLGPQGGPGMPEMLAPTSALVGQGLGESVGLITDGRFSGGTWGMVVGHVAPEAYAGGLIALIEEGDSITIDAHTLSLELNVDDKEIARRRGAWVKPEPRYTRGVLAKFAKNAATASRGAVLDLYED

SEQ ID NO: 375 - DNA, 1665 bp, Tremblaya princeps
atgaacacgaactcaagacgcataacgcatggattcaccaggtctccgaacagggccatgctctgtgccatggggtacgatggcgcagactttgccaagcccatcataggcgtaggaagcggttactccaccataacaccgtgcaatgctggcatacagcgcgtcgtcgatgcggcgaaagccatgctggcaaggcatggagccatgacgcaggttttcggcatccctaccatatccgacggcatatcaatgggcacgccgggcatgaggtactctctcgtgtctcgtgaggtgatcgctgattgtatagaggcatgtgcttgtgggcagagcatggacgggctgctagtcgtagggggctgcgataagaacctgcctggtggcatgatcgggctactacgagccaacatcccagggatttacctgtatggcggcacaatactgccagggtactggggcgccagggagctgactgtggtgagttcattcgaggcagttggcgccatgggtaggcagggcatgtctatagacgctatgcgtgaagtggagcgacacgcctgccccactacaggctcgtgcggcgggatgtacacagcaaacacaatgagcgcatcatttgaggcccttggcatgtccctgctctactcgtccactgctccgagcccaggcatcgagggtgagctatccatctcaacgtcggcacggtctctgatcaacgcagtgcgacggggcataaggccaagggacgtggtaactcacaggtccattcgcaatgccatggcggttgtaatggcagtcggcgggtctacaaacgccgtgctgcactacctggcgatagccgctgcagctcgttctgctctctcactgcacgacgttgagctaataaggaggagggtgcctgtaatatgtaacatgaagccctctggactgcatagcactgcagacctacattcagcaggcggcgttcctcgtgttatgcacgagcttgcgctcgctggtctcattgacgagtcgtgcctcacgataacgggcagaacgataggtgcagagctcctcgcggcgcaccgcaagcgccatggctctaccgttgtgctgcctactaacatggcgttataccgtacaggacgccttgttgtgctgagcggtaatatgtcaaggaacggcgcagttgccaagacttcaggccttagcatactattgcacagcggcactgccagagtgtttcgcagcgaggaggcctgtgttcaggctatactcaacggctgcgtgcgcattggcgacgtagttgtgctgatttacctaggcccaaagggagggcctggcatgcctgagatgctatccccaactgcagcgctagttggcatgggactaggccagtccgcttgcctcattacagatggtaggttctctggaggaacgtggggcctggtggtcgggcatgtatcacccgaggcagccgtgggtggctccatagcgcttgtccgtaacggcgacttcatcacagtagacctgcgcaacaactctcttcacctgcatatagacgcatggtcgcttgctgcacggcgtgcagcatggcggctaccttgcactttgtgtgtagagggactactgagaaagtaccacgatggagttggccagtctcacaatggcgccatcgctgcatag

SEQ ID NO: 376 - protein, 554 aa, Tremblaya princeps
MNTNSRRITHGFTRSPNRAMLCAMGYDGADFAKPIIGVGSGYSTITPCNAGIQRVVDAAKAMLARHGAMTQVFGIPTISDGISMGTPGMRYSLVSREVIADCIEACACGQSMDGLLVVGGCDKNLPGGMIGLLRANIPGIYLYGGTILPGYWGARELTVVSSFEAVGAMGRQGMSIDAMREVERHACPTTGSCGGMYTANTMSASFEALGMSLLYSSTAPSPGIEGELSISTSARSLINAVRRGIRPRDVVTHRSIRNAMAVVMAVGGSTNAVLHYLAIAAAARSALSLHDVELIRRRVPVICNMKPSGLHSTADLHSAGGVPRVMHELALAGLIDESCLTITGRTIGAELLAAHRKRHGSTVVLPTNMALYRTGRLVVLSGNMSRNGAVAKTSGLSILLHSGTARVFRSEEACVQAILNGCVRIGDVVVLIYLGPKGGPGMPEMLSPTAALVGMGLGQSACLITDGRFSGGTWGLVVGHVSPEAAVGGSIALVRNGDFITVDLRNNSLHLHIDAWSLAARRAAWRLPCTLCVEGLLRKYHDGVGQSHNGAIAA

SEQ ID NO: 377 - DNA, 1689 bp, Blastopirellula marina
atgtctcagcccctcaattggaatagtcgccgtttaacgcgtggatggcaaaaagggatcaccgctttttattacggcttgggactgaccgacgccgattttgacaaaccgcagatcgggatcggcgtgccgctgctggacggcaatctttgcaacgtccacgcctatcaactgggccaagagctgaaagcaggctgcgagcaagcgggactgatcgggtttccgtttggcacgccggccgttagcgataacatcacgcaaggacatgaagggggcaacgccagccttccctcgcgtaatatgatcgccaatgcggctgaatgcgtcgtcagcgcccatggctacgactttttgatcggactgcacaattgcgacaaaaacgggcccggcttcgccatggcgttggctcggctcaactatcccgggctgatcgtcaacggcggcagtattaaacctggttgccatctgggccgcgacacgtcgatcttggatgtctacgacgcccaagcggcggcttccgtgggcgcaatgacggcggacgaagcggatcagatcttgcgaaccgcttgtcccggacccggcgggtgcggcatcgccgcttcttttaatacttggggaatcgcgatcgaagcgatcgggctagggcttccctactccagttcgatcccggctgaagatccggccaaacgcgaagaatgccgcagcatcggccaagcagtcaagcatctgctgaccgagaacattcgcccccgcgatattttgaccaaaaaggcgtttgaaaacgcagccgcggtgatcgccgccgtgggcggctcgaccaacggcgtgctgcacctgatcgcgctggccaaagaagccgaagttgatttcacattgcgtgacgtgcagcggattgtccgcaacacgccggtcctgtgcagcttcgctccgcgcggcaaacgcacgatgtacgacctgcacaagctggggggtacgccgatgctgctgaagtacttgatctcggtcggcattgtcgatggttcgtgcctgaccgtctcgggcaagtcattggccgaaaacgtcaacggcgcggccgatgttcccgcggatcaagacttgatcgcgacgatcgaaaagccgttcaaagaatatgccgacatgcagatctgctttggcaacctggcgcccggcggcgtggtcttcaaagtatcgagcatgcgtgacccaaaattcagcggcaaagcgatctgcttttcggaagccaaggatatcgtcaacgcggtcgaagcgaataagatcacgccgggaaccgtgatcgtgcttcgttatctggggccggtcgcttcggggatgccggaagtgttggtcgcgaccgcggctttggccgtaccgcatctggacggcaaagtagcgtttctgtcagacacgcgcgtctctggcgtatcgcacggagcgatcggcgttcactgtgctccggaagcggcagtcggcgggccgatcgcgttggtggaagacggggatgaaatctcgtttgatctgctcggcggcgagatcacgctgcacgtcggagcagacgtgttggcgactcgcgccgccaactggaagacgcctgacctgcggcacaaacatgcctatctggccgacttcgccgcaaccgtctcgcaagccgatagcggttgcgtcagcaaagcgtttcacgacgtctcgtaa

SEQ ID NO: 378 - protein, 562 aa, Blastopirellula marina
MSQPLNWNSRRLTRGWQKGITAFYYGLGLTDADFDKPQIGIGVPLLDGNLCNVHAYQLGQELKAGCEQAGLIGFPFGTPAVSDNITQGHEGGNASLPSRNMIANAAECVVSAHGYDFLIGLHNCDKNGPGFAMALARLNYPGLIVNGGSIKPGCHLGRDTSILDVYDAQAAASVGAMTADEADQILRTACPGPGGCGIAASFNTWGIAIEAIGLGLPYSSSIPAEDPAKREECRSIGQAVKHLLTENIRPRDILTKKAFENAAAVIAAVGGSTNGVLHLIALAKEAEVDFTLRDVQRIVRNTPVLCSFAPRGKRTMYDLHKLGGTPMLLKYLISVGIVDGSCLTVSGKSLAENVNGAADVPADQDLIATIEKPFKEYADMQICFGNLAPGGVVFKVSSMRDPKFSGKAICFSEAKDIVNAVEANKITPGTVIVLRYLGPVASGMPEVLVATAALAVPHLDGKVAFLSDTRVSGVSHGAIGVHCAPEAAVGGPIALVEDGDEISFDLLGGEITLHVGADVLATRAANWKTPDLRHKHAYLADFAATVSQADSGCVSKAFHDVS

SEQ ID NO: 379 - DNA, 1692 bp, Planctomyces maris
atggatcatcctttaaactggaatagtcaaaacctgacacatggctggcaacggggagtcaccgctttttattacgggttaggcttttcggatcaggatttcgacaaggcccagatcgggattggcgtgccactcttggatggcaacctctgtaatgtgcatgcttacgatcttgcgaaagtaattgcacagggatgtcaatccgctgacatgatcggtcttccttttggagttcccgccgtcagtgacaacatcacccagggacaggaaggaggcaacgccagtctcccctctcggaatatgatcgccaacgcggccgaatgcgtcgtgagtgctcattcgtatgatgccctgattggcctgcataattgcgataaaaacggaccgggcttcgccatggcattggcacgactcaactatccgggactggtcgtcagtggtggcagtatcatgcccggctgccacaaaggacaggacatttcgatcctcgacgtctacgattcccaggcagctgcagcagtcggcgcgatggaagaagaagaagcggaccagattctgaaaaccgcctgcccgggcccggggggatgtggtatcgccgcttctttcaatacctggggcatcgcgctcgaagccatcggccttatgctcccgttcagcagttccacgccggccattgataatgcaaaaaaaacagaatgcctcaatgtcgcctctgccgtgcgaaatctcctgcagaaaaatatccggccgcgcgacatcctgacccgcaaagcatttgaaaatgcagccgccaccatcgcggccgtcggcggctccacgaatggaatcctgcatctgctcgcgctggcacgagaagcggaagtcgaattttacctgcaggacattcaggaaattcttcgaaaaacgcccgtgtattgcagttttgcaccacgcggcaaaaaaaccatggtcgacctgcatcacctgggtggcacaccggtcctcatgaaacacctgctcaaagcaggcatcatcgatggcagttgcctgactgtaaccggcagaaccctggcggaaaacctggcagaaatcggcgatgtccccacgaaccaggaactgatcgcttcgctcgatcaaccgtataaaacttacgccgacatgcagatctgctttggcaatctggcaccgggaggcattgtctttaaagtttccagcatgcaggaatcacatttcacgggaaccgcctgctgcttcgatgaagcgaaaggcgtagtcgatgccgtcgaagcaggtaagatcaaacccggcagtgtcatcgtactacgaaacctgggtccggtcgcatcaggcatgcctgaagtacttgtcgcgactgccgctctgacggtaccggaactggatggcaaagtggcattcatttcggacacacgtgtctccggtgtttcacacggtgccatcggcgtgcattgttctcccgaagcggcagtcggaggtccgattggtctgattcaggatggtgaccagatctcgttcgatctgcttaaaggagaaatcagcgttgatgtctccgaccaggaatttcagcaacgccgagtgaaaaaaccacttcaacccgtcagacattcccgcggctatctggctgatttttcagccaccacctcacaggcacatcatggctgtgtgagtaaagccctgctgccggactgcgaataa

SEQ ID NO: 380 - protein, 563 aa, Planctomyces maris
MDHPLNWNSQNLTHGWQRGVTAFYYGLGFSDQDFDKAQIGIGVPLLDGNLCNVHAYDLAKVIAQGCQSADMIGLPFGVPAVSDNITQGQEGGNASLPSRNMIANAAECVVSAHSYDALIGLHNCDKNGPGFAMALARLNYPGLVVSGGSIMPGCHKGQDISILDVYDSQAAAAVGAMEEEEADQILKTACPGPGGCGIAASFNTWGIALEAIGLMLPFSSSTPAIDNAKKTECLNVASAVRNLLQKNIRPRDILTRKAFENAAATIAAVGGSTNGILHLLALAREAEVEFYLQDIQEILRKTPVYCSFAPRGKKTMVDLHHLGGTPVLMKHLLKAGIIDGSCLTVTGRTLAENLAEIGDVPTNQELIASLDQPYKTYADMQICFGNLAPGGIVFKVSSMQESHFTGTACCFDEAKGVVDAVEAGKIKPGSVIVLRNLGPVASGMPEVLVATAALTVPELDGKVAFISDTRVSGVSHGAIGVHCSPEAAVGGPIGLIQDGDQISFDLLKGEISVDVSDQEFQQRRVKKPLQPVRHSRGYLADFSATTSQAHHGCVSKALLPDCE

SEQ ID NO: 381 - DNA, 1851 bp, Esherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 382 - protein, 616 aa, Esherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 383 - DNA, 1812 bp, Esherichia coli
atgaatccacaattgttacgcgtaacaaatcgaatcattgaacgttcgcgcgagactcgctctgcttatctcgcccggatagaacaagcgaaaacttcgaccgttcatcgttcgcagttggcatgcggtaacctggcacacggtttcgctgcctgccagccagaagacaaagcctctttgaaaagcatgttgcgtaacaatatcgccatcatcacctcctataacgacatgctctccgcgcaccagccttatgaacactatccagaaatcattcgtaaagccctgcatgaagcgaatgcggttggtcaggttgcgggcggtgttccggcgatgtgtgatggtgtcacccaggggcaggatggaatggaattgtcgctgctaagccgcgaagtgatagcgatgtctgcggcggtggggctgtcccataacatgtttgatggtgctctgttcctcggtgtgtgcgacaagattgtcccgggtctgacgatggcagccctgtcgtttggtcatttgcctgcggtgtttgtgccgtctggaccgatggcaagcggtttgccaaataaagaaaaagtgcgtattcgccagctttatgccgaaggtaaagtggaccgcatggccttactggagtcagaagccgcgtcttaccatgcgccgggaacatgtactttctacggtactgccaacaccaaccagatggtggtggagtttatggggatgcagttgccaggctcttcttttgttcatccggattctccgctgcgcgatgctttgaccgccgcagctgcgcgtcaggttacacgcatgaccggtaatggtaatgaatggatgccgatcggtaagatgatcgatgagaaagtggtggtgaacggtatcgttgcactgctggcgaccggtggttccactaaccacaccatgcacctggtggcgatggcgcgcgcggccggtattcagattaactgggatgacttctctgacctttctgatgttgtaccgctgatggcacgtctctacccgaacggtccggccgatattaaccacttccaggcggcaggtggcgtaccggttctggtgcgtgaactgctcaaagcaggcctgctgcatgaagatgtcaatacggtggcaggttttggtctgtctcgttatacccttgaaccatggctgaataatggtgaactggactggcgggaaggggcggaaaaatcactcgacagcaatgtgatcgcttccttcgaacaacctttctctcatcatggtgggacaaaagtgttaagcggtaacctgggccgtgcggttatgaaaacctctgccgtgccggttgagaaccaggtgattgaagcgccagcggttgtttttgaaagccagcatgacgttatgccggcctttgaagcgggtttgctggaccgcgattgtgtcgttgttgtccgtcatcaggggccaaaagcgaacggaatgccagaattacataaactcatgccgccacttggtgtattattggaccggtgtttcaaaattgcgttagttaccgatggacgactctccggcgcttcaggtaaagtgccgtcagctatccacgtaacaccagaagcctacgatggcgggctgctggcaaaagtgcgcgacggggacatcattcgtgtgaatggacagacaggcgaactgacgctgctggtagacgaagcggaactggctgctcgcgaaccgcacattcctgacctgagcgcgtcacgcgtgggaacaggacgtgaattattcagcgccttgcgtgaaaaactgtccggtgccgaacagggcgcaacctgtatcactttttaa

SEQ ID NO: 384 - protein, 603 aa, Esherichia coli
MNPQLLRVTNRIIERSRETRSAYLARIEQAKTSTVHRSQLACGNLAHGFAACQPEDKASLKSMLRNNIAIITSYNDMLSAHQPYEHYPEIIRKALHEANAVGQVAGGVPAMCDGVTQGQDGMELSLLSREVIAMSAAVGLSHNMFDGALFLGVCDKIVPGLTMAALSFGHLPAVFVPSGPMASGLPNKEKVRIRQLYAEGKVDRMALLESEAASYHAPGTCTFYGTANTNQMVVEFMGMQLPGSSFVHPDSPLRDALTAAAARQVTRMTGNGNEWMPIGKMIDEKVVVNGIVALLATGGSTNHTMHLVAMARAAGIQINWDDFSDLSDVVPLMARLYPNGPADINHFQAAGGVPVLVRELLKAGLLHEDVNTVAGFGLSRYTLEPWLNNGELDWREGAEKSLDSNVIASFEQPFSHHGGTKVLSGNLGRAVMKTSAVPVENQVIEAPAVVFESQHDVMPAFEAGLLDRDCVVVVRHQGPKANGMPELHKLMPPLGVLLDRCFKIALVTDGRLSGASGKVPSAIHVTPEAYDGGLLAKVRDGDIIRVNGQTGELTLLVDEAELAAREPHIPDLSASRVGTGRELFSALREKLSGAEQGATCITF

SEQ ID NO: 385 - DNA, 1752 bp, Azospirillum brasiliense
atgtcggcaacgaaacccaggctgcgctctacccaatggttcggcacgaacgacaagaacggcttcatgtaccggagctggatgaagaaccagggcatccccgatcacgagttcgacggccggccgatcatcggcatctgcaatacgtggtccgaactgacgccgtgcaacgcgcacttccgcaagctcgccgagcacgtgaagcgcgggatctccgaggcgggcggcttcccggtcgagttcccggtgttctcgaacggtgaatcgaacctgcgcccttcggcgatgctcacgcgcaacctcgcgtcgatggacgtcgaggaggcgatccgcggcaacccgatcgacgcggtcgtgctgctcgccggctgcgacaagacgacgcccgcgctgctgatgggcgcggcgagctgcgacgtgccggcgatcgtcgtgtccggcggcccgatgctgaacggcaagctggagggcaagaacatcggctccggcaccgccgtgtggcagttgcacgaagcgctgaaagccggcgagatcgatgtccatcacttcctgtcggccgaagccgggatgtcgcgctcggccggcacctgcaacacgatgggcaccgcgtcgacgatggcgtgcatggccgaggcgctcggcgtcgcgctgccgcacaacgcggcgattccggccgtcgattcgcgccgctacgtgctcgcgcacatgtcgggcatccgcatcgtcgaaatggcgctcgaagggctcgtgctgtcgaagatcctgacgcgcgcggcgttcgagaacgcgatccgcgcgaacgcggcgatcggaggctcgaccaacgcggtgatccacctgaaggcgatcgcgggccgcatcggcgtgccgctcgaactggaagactggatgcgcatcggccgcgacacgccgacgatcgtcgacctgatgccgtcggggcgcttcccgatggaagagttctattacgcgggcggcctgccggcggtgttgcgccggctcggcgaaggcgggctgctgccgaacccggatgcgctgacggtgaacggcaagtcgctgtgggacaacgtgcgcgaagcgccgaactacgacgaggaagtaatccgcccgctcgaccggccgctgatcgcggacggcggcatccgcatcctgcgcggcaatctcgcgccgcgcggcgcggtgctgaagccgtcggcggcgagccccgagttgctgaagcatcgcggtcgcgcggtcgtgttcgagaacctcgaccactacaaggcgacgatcaacgacgaggcgctcgacatcgacgcaagctcggtgatggtgctgaagaactgcgggccgcgcggttatccggggatggccgaggtcggcaacatggggctgccgccgaagctgttgcgccagggcgtgaaggacatggtccggatttccgacgcgcggatgagcggcaccgcgtacggcacggtcgtgctgcacgtcgcgccggaagccgctgccggcgggccgctcgcggccgtgcgcaacggcgactggatcgagctcgactgcgaggccggcacgctgcatctggacattacggacgacgaactgcatcgccgcctgtcggacgtcgatccgaccgcggcgccgggcgtggccggccagctcggcaagggcggctatgcgcggctgtacatcgatcacgtgctgcaggccgacgaggggtgcgacctcgacttcctggtcggcacgcgcggcgctgaagtgccgagccattcgcattga

SEQ ID NO: 386 - protein, 583 aa, Azospirillum brasiliense
MSATKPRLRSTQWFGTNDKNGFMYRSWMKNQGIPDHEFDGRPIIGICNTWSELTPCNAHFRKLAEHVKRGISEAGGFPVEFPVFSNGESNLRPSAMLTRNLASMDVEEAIRGNPIDAVVLLAGCDKTTPALLMGAASCDVPAIVVSGGPMLNGKLEGKNIGSGTAVWQLHEALKAGEIDVHHFLSAEAGMSRSAGTCNTMGTASTMACMAEALGVALPHNAAIPAVDSRRYVLAHMSGIRIVEMALEGLVLSKILTRAAFENAIRANAAIGGSTNAVIHLKAIAGRIGVPLELEDWMRIGRDTPTIVDLMPSGRFPMEEFYYAGGLPAVLRRLGEGGLLPNPDALTVNGKSLWDNVREAPNYDEEVIRPLDRPLIADGGIRILRGNLAPRGAVLKPSAASPELLKHRGRAVVFENLDHYKATINDEALDIDASSVMVLKNCGPRGYPGMAEVGNMGLPPKLLRQGVKDMVRISDARMSGTAYGTVVLHVAPEAAAGGPLAAVRNGDWIELDCEAGTLHLDITDDELHRRLSDVDPTAAPGVAGQLGKGGYARLYIDHVLQADEGCDLDFLVGTRGAEVPSHSH

SEQ ID NO: 387 - DNA, 1839 bp, Salinibacter ruber
gtgaggctgccgtctttcacgcttcacgtttcacgcatcacgaaaacagcaccttctttcccttccacttttcccttttgcccaatgcccccctcctccgccaacggccactcctccaaaatccagagccaagacgtcaccgagggccttgaccaggcgccggcccgcgcgatgtttcgggcgatgggctacgacgacgccgacctcgaccagcccctcatcggcatcgccaacccggcggcggacgtgacgccctgcaatgtgcacctcgacggccttgccgacgccgcacgcgaaggcgtcactgaggccggcgggacgcccatcgagtttggcaccatcacggttagcgacgggatctcgatgggcacggagggcatgaaggggtccctcatctcccgcgaggtgatcgccgactcggtggaactggtggcctttgccgagcggctcgacgggctcgtcatcatgggcggctgcgacaaaaacatgccgggcatgatgatggcggcgatccgggccgacctcccgagcgtcttcctctacggcgggtccatcatgccgggccaccaccgggggcaggagatcacgatccagaacgtgttcgaggcgtgcggggcggtcgccaccggccagatgagcgaagaggagctcgacgagatggagcgccacgcctgtcccggcgccggcgcctgcggcggcatgttcaccgctaacacaatggcgtccatcagcgaggcgatcggctttgcgccgctggggagcgcgagccccccggcggtgacagaagaacgagaggtggtggcccgcgcggccgggcggcggaccgtcgaggcgatcgaggaacggcggcggccctccgacttcctcagcaagaagtcgttcgagaacgccattgccctccaggtggccgtgggcggctccacgaacggcgtactccacctgctcgcgatggcggcggaggcgggcatcgacctctcgattgaggcgttcgacgcaatcagccggcggacgcccaagatcggcgacttccagcccggcggctcccgcgtgatgaacgacctgcacgaggtcggcggcgtgccggtggtgctgaaggcgcttctcgatgcgggcctgctgcacggcgacgcccagaccgtgacgggggagcccctcgccgaggccctcgaccgcgtcgacccgcccgccatcgcggacctcgacgtggactacctctacacggtggacgaaccgaagaatgaggagggcgccatccgcatcctcaccggcaacctcgcccccgacggcgctgtgctcaaagttacagccgctgatgccccccgctttgagggcacggcccgcgtcttcgagagcgaggaggacgcaatggactacgtgcaggccggccagctcgactcgggcgacgtcattatcattcggaatctcgggcccaagggcgcccccggcatgcccgaaatgcttggcgtgaccgccgcccgggacggacaggggcacgccgacgacgtggccctcatcaccgacgggcgcttctccggggccacccgcggcctctccatcggccacgtcgcccccgaggccgcggccggcgggcccatcgccgccatccaggacggagacccgatcatcatcgacgtggcggagcgtcacctggcggtcgacctgtccgacgccgagctggagcgccgactcgacgaccggtcgcccccggagccccagtacacgaccggcgttctcgccaagtacgccgccctcttcggctccgccgcggagggggcagtgacgagtgtcttttcggatcttcgcgagtcgacatccccctccacggcttcaaatgaatga

SEQ ID NO: 388 - protein, 612 aa, Salinibacter ruber
MRLPSFTLHVSRITKTAPSFPSTFPFCPMPPSSANGHSSKIQSQDVTEGLDQAPARAMFRAMGYDDADLDQPLIGIANPAADVTPCNVHLDGLADAAREGVTEAGGTPIEFGTITVSDGISMGTEGMKGSLISREVIADSVELVAFAERLDGLVIMGGCDKNMPGMMMAAIRADLPSVFLYGGSIMPGHHRGQEITIQNVFEACGAVATGQMSEEELDEMERHACPGAGACGGMFTANTMASISEAIGFAPLGSASPPAVTEEREVVARAAGRRTVEAIEERRRPSDFLSKKSFENAIALQVAVGGSTNGVLHLLAMAAEAGIDLSIEAFDAISRRTPKIGDFQPGGSRVMNDLHEVGGVPVVLKALLDAGLLHGDAQTVTGEPLAEALDRVDPPAIADLDVDYLYTVDEPKNEEGAIRILTGNLAPDGAVLKVTAADAPRFEGTARVFESEEDAMDYVQAGQLDSGDVIIIRNLGPKGAPGMPEMLGVTAARDGQGHADDVALITDGRFSGATRGLSIGHVAPEAAAGGPIAAIQDGDPIIIDVAERHLAVDLSDAELERRLDDRSPPEPQYTTGVLAKYAALFGSAAEGAVTSVFSDLRESTSPSTASNE

SEQ ID NO: 389 - DNA, 1485 bp, Vibrio cholerae
atggcgaattatttcaatacgctgaatctgcgtgaacagttggatcaacttggtcgttgccgttttatggcgcgagaagagtttgcaaccgaagctgattacctaaaaggtaagaaagtggtgatcgtaggttgtggggctcaaggcctaaaccaaggcctcaatatgcgtgattcaggtttggatgtttcttacgctctgcgtcaggctgcgattgatgaacagcgtcagtcatttaagaatgccaagaataatggcttcaacgtgggtagttatgaacaactcatcccaaccgcagatttggtgattaacttgacgccagacaagcagcacaccagtgtggtcaatgcggtgatgcctctgatgaagcaaggtgctgccttgggttactcacacggttttaatatcgttgaagagggcatgcagatccgtaaagacatcacggttgtgatggtggcaccaaaatgtccgggtacggaagttcgtgaagagtataagcgcggtttcggcgttcctactcttatcgcggtacaccctgaaaacgatccacaaggtgaaggttgggaaattgctaaagcgtgggctgcggcaacgggtggccatcgtgcgggctgtttagcttcttcttttgtggcggaagtgaaatccgatttgatgggtgagcaaaccattctctgcggtatgctgcaagcgggctctatcgtttgttacgagaaaatggttgctgatggcatcgaccctggttatgcgggcaagcttttgcaatttggttgggaaaccattaccgaagcactcaagtttggcggtattactcatatgatggatcgcctgtctaaccctgcaaaaatcaaagcgtttgagctgtctgaagagttgaaagatctgatgcgcccactgtacaacaagcatatggatgacatcatttctggccacttctctagcaccatgatggcggattgggcgaatgatgataaagacttattcggctggcgtgcagaaaccgctgagacgacctttgaaaactatccaacaaccgacgtaaaaattgctgagcaagaatactttgataacggtattttgatgattgccatggtgcgtgctggggttgagttggcgtttgaagcgatgacggcttcaggcatcatcgatgagtcggcttactatgaatcactgcacgaactcccactgattgccaatacggtagcgcgtaagcgtctgtatgaaatgaacgtggtaatctctgacactgctgagtacggtaactatctgtttgccaatgtggcggtaccactattgcgtgaaaagtttatgccgaaagtgggcactgatgtgattggtaaaggattaggcgtggtctctaatcaagttgataacgcaacgcttatcgaagtaaacagcatcatccgtaaccatccggttgagtatatcggtgaagagctacgcggttacatgaaagacatgaagcgcatcgccgtgggtgattaa

SEQ ID NO: 390 - protein, 494 aa, Vibrio cholerae
MANYFNTLNLREQLDQLGRCRFMAREEFATEADYLKGKKVVIVGCGAQGLNQGLNMRDSGLDVSYALRQAAIDEQRQSFKNAKNNGFNVGSYEQLIPTADLVINLTPDKQHTSVVNAVMPLMKQGAALGYSHGFNIVEEGMQIRKDITVVMVAPKCPGTEVREEYKRGFGVPTLIAVHPENDPQGEGWEIAKAWAAATGGHRAGCLASSFVAEVKSDLMGEQTILCGMLQAGSIVCYEKMVADGIDPGYAGKLLQFGWETITEALKFGGITHMMDRLSNPAKIKAFELSEELKDLMRPLYNKHMDDIISGHFSSTMMADWANDDKDLFGWRAETAETTFENYPTTDVKIAEQEYFDNGILMIAMVRAGVELAFEAMTASGIIDESAYYESLHELPLIANTVARKRLYEMNVVISDTAEYGNYLFANVAVPLLREKFMPKVGTDVIGKGLGVVSNQVDNATLIEVNSIIRNHPVEYIGEELRGYMKDMKRIAVGD

SEQ ID NO: 391 - DNA, 1014 bp, Pseudomonas  fluorescens
atgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaac

SEQ ID NO: 392 - protein, 338 aa, Pseudomonas  fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 393 - DNA, 1047 bp, Achromobacter xylosoxidans
atgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctga

SEQ ID NO: 394 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 395 - DNA, 38 bp, artificial sequence
  primer
tagctagcatgactgacaaaaaaactcttaaagactta

SEQ ID NO: 396 - DNA, 45 bp, artificial sequence
  primer
tgcggccgctcattttttgccagtttcttcaggcttccaaaagtc

SEQ ID NO: 397 - DNA, 35 bp, artificial sequence
  primer
acgcggccgctgagatccggctgctaacaaagccc

SEQ ID NO: 398 - DNA, 81 bp, artificial sequence
  primer
atgctagctatctccttcttaaagttaaacaaaatttgcggccgctcattttttgccagtttcttcaggcttccaaaagtc

SEQ ID NO: 399 - DNA, 41 bp, artificial sequence
  primer
ttactagtatgtccaacaatcccagaagccaggtaattacc

SEQ ID NO: 400 - DNA, 41 bp, artificial sequence
  primer
ttgctagcatgccagataatcgacgcagccaaaccattacc

SEQ ID NO: 401 - DNA, 43 bp, artificial sequence
  primer
ttgcggccgcttaatcggtgactgcaccacggctggcagtgga

SEQ ID NO: 402 - DNA, 43 bp, artificial sequence
  primer
ctactagtatggaggaaaacatcgtgtctgaaaataacatgaa

SEQ ID NO: 403 - DNA, 53 bp, artificial sequence
  primer
tagcggccgcttaagctttacctgatttatccatattccagaagtcagtaacc

SEQ ID NO: 404 - DNA, 47 bp, artificial sequence
  primer
ttgctagcatggcttacaacaaacgttcccagcacatcacgcaaggc

SEQ ID NO: 405 - DNA, 55 bp, artificial sequence
  primer
ttgcggccgctcagtccgtcacggcacccttgctggccgtggaggccagcctcgc

SEQ ID NO: 406 - DNA, 47 bp, artificial sequence
  primer
ttactagtatggcattcaacaaacgctcgcagaacatcacgcaaggc

SEQ ID NO: 407 - DNA, 63 bp, artificial sequence
  primer
tgcggccgctcagtccgtcactgcacccttgcttgccgtcgacgccagcttcgagaacttcgc

SEQ ID NO: 408 - DNA, 55 bp, artificial sequence
  primer
cagtaacggatccggggaggtcaaaaagataacatatggaattcaaatataacgg

SEQ ID NO: 409 - DNA, 52 bp, artificial sequence
  primer
atttgtggatccgcggccgcctataaatctgtaacgcaaccttcactagcgg

SEQ ID NO: 410 - DNA, 3748 bp, artificial sequence
  vector
gacgaaagggccttataacttacaaataacccctcgaaaacattgaaagaataacccccaagatctatattatagatcttgggggttatttgttttaatattaaagaaatgacttcttctatttgtcatcaatactaaacaataatttgtacaaagtgattatttcttctagttcttcacgcgatacatgatcgacaatagtttcatcagtgacatgtcttgcccgtaaatctaaggctatggtttgatctaataatacttttccatatactgtttgactactagttagtcgatgatacattggaaaattacgcttggtactgctaattggagccacaatcgtcatgttacttgtctgacagactagatcattgcttagcgcaatggctggtcgcttattcatctgttcatgaccacggcttggattaaagttaacataaaatatatcaccttggcttaccattgaagttcattaccttctgactttccccaatcaagctcgtgatcccttttcccgtcatctttccaatccttaaatagttcgtgaatattggttgggttcttttttattggtgttaaaacaattgatccattttcaatggttattgtcatatcttggttatcatctaatttcagttgtttaataatttggctaggaattctagcagctttcgagtttccccactttgctaagcgtgtttgttctttaataagttccatattttcccctcctaaattattattacaagtcaagtatatcccatgtagatacacaatgcaaatattcttactggagaaataacaccttaagtctagcaccacccgcacgcatagcggtgcttaaaccatcaagggtcaagcccttaggctctctcaaacagttatcctaatcgtgaataactgcgcttcttttgcagtataaagagagaactctttatcagacaatttaagctcaaccagcccttgcactaactattattagagttggttttagcagcaacccgaataatctgcgttaatagttagcctgtccgtatcatttcctagtcttccagccacgtctttagtcgcgttgatctcgacaaggtttagcatacctatgttgttaactgcaagcggggtcacgaacgacactcacgggaggttttactagctaagaacaggtttccagcctttagttgctttgatggttgctaaccattgaataacaaaaaaacggttgctatcaggtttctgttaagattcccgataacaaccgtttactttaagtatcaatggttgaaaaacttagcctacatgttataatagtaccaagttagatagcttgtattggtagtacttgctatcgaaaatcttatcaggttgtgctgataagtcgtgaatcctaactctgctaagttgagggttcttttttttgcgttcatttattaagttgagtacattataaccgtaatataagattaatacaacctttatcattttaacgtctcaaccagccgaataatccttaaaaaaggattgattctaatgaagaaagcagacaagtaagcctcctaaattcactttagataaaaatttaggaggcatatcaaatgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataagggcccgcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtctcgaggaccgagcgcagcgagtcagtgagcgaggaagcggaagagcgagggcggagttgttgacagccgaggtaccatgtggtataatcccgagtgtggaattgtgagcggataacaatttcacacaggaaacagctatgaccatgattacgccaagcttggctgcaggtcgacggatccccgggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 411 - DNA, 16387 bp, artificial sequence
  vector
gatcctctagtttctcggtactatgcatatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttaacaaagatatgctattgaagtgcaagatggaaacgcagaaaatgaaccggggatgcgacgtgcaagattacctatgcaatagatgcaatagtttctccaggaaccgaaatacatacattgtcttccgtaaagcgctagactatatattattatacaggttcaaatatactatctgtttcagggaaaactcccaggttcggatgttcaaaattcaatgatgggtaacaagtacgatcgtaaatctgtaaaacagtttgtcggatattaggctgtatctcctcaaagcgtattcgaatatcattgagaagctgcattttttttttttttttttttttttttttttatatatatttcaaggatataccattgtaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgttccacttccagatgaggcgctggaagcctccaagaaggctgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgttagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaagttcaacatcaattgattgattctgccgccatgatcctagttaagaacccaacccacctaaatggtattataatcaccagcaacatgtttggtgatatcatctccgatgaagcctccgttatcccaggctccttgggtttgttgccatctgcgtccttggcctctttgccagacaagaacaccgcatttggtttgtacgaaccatgccatggttccgctccagatttgccaaagaataaggtcaaccctatcgccactatcttgtctgctgcaatgatgttgaaattgtcattgaacttgcctgaagaaggtaaagccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacaaaaaaaaaaaaaaaaaaaaaaaaaaaaaaaaaaaaaaaaaaaaaaaaaaaatgcagcgtcacatcggataataatgatggcagccattgtagaagtgccttttgcatttctagtctctttctcggtctagctagttttactacatcgcgaagatagaatcttagatcacactgcctttgctgagctggatcaatagagtaacaaaagagtggtaaggcctcgttaaaggacaaggacctgagcggaagtgtatcgtacagtagacggagtatactagagtcgacctgcaggcatgcaagcttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaaattgtaaacgttaatattttgttaaaattcgcgttaaatttttgttaaatcagctcattttttaaccaatagaccgaaatcggcaaaatcccttataaatcaaaagaatagcccgagatagagttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctaaggcgctggcaagtgtagcggtcacgctgcgcgtaaccaccacacccgccgcgcttaatgcgccgctacagggcgcgtactatggttgctttgacgtatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccaccgcggatagatctgaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctagagctgaggatgttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataattaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgctctagagagttgttagcaaccttttgtttcttttgagctggttcagacattatgtacacgtatatgtgacgagttcgagaagtattttactatcgtactaaattttacctgaaaaattatatactcgagaaagaggaagccaagaattgagaaaaaagaaaaacccgcgagtaaggaaattaaatacaggtgtacacatacacgcacacatatatatatatatatatatgtatatgtgtatataggaagcgcgcgcatgttagtatatacgattcgttggaaaggggccgtccaccaaacgtgacttgacgagttgacaaattgacctcaatatggctcagtcagtaatttttagttccgctttattcccgccatctttcaggccacgagggtagctcataacgccgcgctaatgccgctgcgtcacagcaaccagtagctcagccaaaaccgaaagagaaatcgtagctgtcccgatgaggacttatacacttgtcaccatctaaataaattatttattcgcgtttcggttcttgttttcgatttaattagattgttcattgaatcataataaatatgtaaaaaatatatatatttgaagctgcttcagaaaaacagggcttcctagtgtacagatgtatgtcggatgaaaaaaaaaaaatcttaaatgtgaaattgggtcaattcaattgactatgacttgatgttgcaaaaattccaagagaaaaagtttccagcacttgatattattttcctctttaatttttcgccttgtctacgatcttattagcaccgatccagggcatcatagaccttaactgttcaccaataatttcgataccatgtgctgcattgtttcttcttttagcagtcatactcgggtaacccgtagcgccttcacttatgaacatcttagcgtattcaccgtcctggatacgtttcaaggcatttctcatggcttgtcttgattctgcgttaatgacttcaggtccggtgacatactcaccatattctgcattatttgaaatggaatagttcatattagctataccaccttcatacattaagtctactatcaacttcaattcatgtagacattcgaagtatgccatttcgggagcgtaccctgcttcgacaagcgtctcaaagcctgctttaaccaattcaacagttcctccgcacagaaccgcttgttctccaaataaatctgtctcagtctcgtctttaaaagtggtttctattatacccgttctcccgccaccaactcctgctgcgtagcttaaagctacattcttagcgtttccgcttgcgtcttggtatatagcgatcaaatctggaataccaccacccttaacaaattcgctcctaacagtatgccccggagccttaggtgcaatcataataacgtccaaatctgccctggggactacttgattgtaatgaatggcaaatccatgactgaaggccaaggtagcgcccttcttaatgtttggttctatttcatttttgtacaattgcgattgaaattcatctggcgttaaaatcatgactaaatcagcgccggcaacagccgctgcaacatctgtgactttcaagccatgtgcttcagcctttgcaacggtagcactaccttttctcagacctactgtcacgtcgaccccagaatctttcaagttacaggcttgtgcgtgtccttgggaaccatatcctataatagcaaccttctttccctggatgatgctcagatcgcagtctttatcgtaaaacaccttcatgttttattttttacttatattgctggtagggtaaaaaaatataactcctaggaataggttgtctatatgtttttgtcttgcttctataattgtaacaaacaaggaaagggaaaatactgggtgtaaaagccattgagtcaagttaggtcatcccttttatacaaaatttttcaattttttttccaagattcttgtacgattaattattttttttttgcgtcctacagcgtgatgaaaatttccgcctgctgcaagatgagcgggaacgggcgaaatgtgcacgcgcacaacttacgaaacgcggatgagtcactgacagccaccgcagaggttctgactcctactgagctctattggaggtggcagaaccggtaccggaggagaccgctataaccggtttgaatttattgtcacagtgtcacatcagcggcaactcagaagtttgacagcaagcaagttcatcattcgaactagccttattgttttagttcagtgacagcgaactgccgtactcgatgctttatttctcacggtagagcggaagaacagataggggcagcgtgagaagagttagaaagtaaatttttatcacgtctgaagtattcttattcataggaaattttgcaaggttttttagctcaataacgggctaagttatataaggtgttcacgcgattttcttgttatgtatacctcttctctgaggaatggtactactgtcctgatgtaggctccttaaattggtgggcaagaataacttatcgatattttgtatattggtcttggagttcaccacgtaatgcctgtttaagaccatcagttaactctagtattatttggtcttggctactggccgtttgctattattcaagtcttttgtgccttcccgtcgggtaagggagttatttagggatacagaatctaacgaaaactaaatctcaatgattaactccatttaatccttttttgaaaggcaaaagaggtcccttgttcacttacaacgttcttagccaaattcgcttatcacttactacttcacgatatacagaagtaaaaacatataaaaagatgtctgtttgtttagccatcacaaaaggtatcgcagtttcttctataggcctctactctggtcttttggcttccgcttcattgattacatctactactccactagaggttttaacaggatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagcgatgattgattgattgattgtacagtttgtttttcttaatatctatttcgatgacttctatatgatattgcactaacaagaagatattataatgcaattgatacaagacaaggagttatttgcttctcttttatatgattctgacaatccatattgcgttggtagtcttttttgctggaacggttcagcggaaaagacgcatcgctctttttgcttctagaagaaatgccagcaaaagaatctcttgacagtgactgacagcaaaaatgtctttttctaactagtaacaaggctaagatatcagcctgaaataaagggtggtgaagtaataattaaatcatccgtataaacctatacacatatatgaggaaaaataatacaaaagtgttttaaatacagatacatacatgaacatatgcacgtatagcgcccaaatgtcggtaatggga

SEQ ID NO: 412 - DNA, 20 bp, artificial sequence
  primer
cgtgttagtcacatcaggac

SEQ ID NO: 413 - DNA, 22 bp, artificial sequence
  primer
catcgactgcattacgcaactc

SEQ ID NO: 414 - DNA, 86 bp, artificial sequence
  primer
tggaataatcaatcaattgaggattttatgcaaatatcgtttgaatatttttccggatctgaaatgaataacaatactgacagtac

SEQ ID NO: 415 - DNA, 61 bp, artificial sequence
  primer
ctcccaatttttcagttgaaaaaggtatatgctctagagcggccgcccgcaaattaaagcc

SEQ ID NO: 416 - DNA, 61 bp, artificial sequence
  primer
ggctttaatttgcgggcggccgctctagagcatatacctttttcaactgaaaaattgggag

SEQ ID NO: 417 - DNA, 84 bp, artificial sequence
  primer
ttcgttacataaaaatgcttataaaactttaactaataattagagattaaatcgcggagcttgtcaatattaatgttaaagtgc

SEQ ID NO: 418 - DNA, 26 bp, artificial sequence
  primer
ccaggccaattcaacagactgtcggc

SEQ ID NO: 419 - DNA, 27 bp, artificial sequence
  primer
cgccgaagaagttaagaaaatccttgc

SEQ ID NO: 420 - DNA, 60 bp, artificial sequence
  primer
aaccataaccaagtaatacatattcagcccatggaattcaaatataacggaaaagttgaa

SEQ ID NO: 421 - DNA, 62 bp, artificial sequence
  primer
tatatcaattaatttgaattaacgcggccgcctataaatctgtaacgcaaccttcactagcg

SEQ ID NO: 422 - DNA, 1014 bp, Pseudomonas  aeruginosa
atgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggcaccgggtcacaccgtgcgttccgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaggccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaatgccgaatacggtgagtacgtaaccggtccggaggtgatcaacgccgagtcccgtgctgccatgcgcaacgccctgaagcgcatccaggacggcgagtacgcgaaaatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaac

SEQ ID NO: 423 - protein, 338 aa, Pseudomonas  aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 424 - DNA, 43 bp, artificial sequence; identical to SEQ ID NO: 401
  primer

SEQ ID NO: 425 - DNA, 643 bp, Saccharomyces cerevisiae
gaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctaga

SEQ ID NO: 426 - DNA, 1686 bp, Microcystis aeruginosa
atggcagataactacagaagtcgcattgttacccaaggtacccaacgcagtcctaatcgggccatgttaagagcggtaggttttggggatgaggactttagcaaaccaatcatcggcattgctaacggatttagcaccattaccccctgtaacatgggaattaatgatttagcaatgcgtgccgaagcagccaccagattagcggggggaatgccgcaacttttcgggactatcaccattagtgacgggatttccatgggaacagaaggaatgaaatattctctcgtttctagggaagtaatcgccgattccattgaaaccgtctgtaatggtcaaagtctcgatggagtcctcgctatcgggggttgtgacaaaaatatgccgggagcaatgattgccatggcccggatgaatattcccgctattttcgtctatggtggcacaattaaaccgggacgctacaaagattgcgatttaaccgtggtcagttcctttgaagccgtgggacagtacagcgccggtaaaatcagcgaagaagacctcatcgggattgaacgcaacgcttgccccggtgctggttcctgtggtggaatgtttactgctaataccatgtcttccatttttgaagccatggggatgagtttaccctattcctcaaccatggccgccgaagatgaggaaaaagccgatagtaccgaagaatcggccaaggttttagtcgaggcggttagaaaacagattctacctagccaaattttgacccgtaaagcctttgaaaacgccatttcggtaattatggcggtgggaggttccactaacgctgtcctgcaccttttagccatttcccgcaccatcggggtagaattatcgatcgatgattttgaaaccatccgccagcgtgtaccagttatctgcgatcttaaaccctccgggcgttacgttaccgtagatctgcataaagccggcggtattccccaagtgatgaaaattctcctggttaatggtttactacacggggatgctctcaccattagcggtcagactatcgccgagattttagccgatattcccgaccaaccgccctcaggccaagatgttatccgtccttttagcaatcctgtctataaagagggtcatttagccattttaaaaggaaatctggccacggaggggtctgtggccaaaatcagcggcgtgaaaactccggtcatcactgggcccgcgcgggtgtttgagtcggaagaaacctgtttagaggcaattttagccggaaaaattcaagccggggatgtggtggttgtccgttacgagggaccagtaggcggaccgggtatgcgggaaatgttagcccccacttcggcaattatcggcgctggtttaggggattccgtgggattaattaccgatggtcgtttttccgggggaacctatggcatggtagttggtcacgtcgctccagaagcggcggtgggtggtacaattgccctagtagaggaaggggatcaaatcactattgatgctcgtcaacgtctcttgagtttaaatgtatcggaggaagaattaacccgtcgtcgtcaccattggcaaccgcgtcccccacgctataaaacgggaattctcggcaaattcgccaagttagtctcctctagcagtctcggcgctttaacggatttgaatctgttctaa

SEQ ID NO: 427 - protein, 561 aa, Microcystis aeruginosa
MADNYRSRIVTQGTQRSPNRAMLRAVGFGDEDFSKPIIGIANGFSTITPCNMGINDLAMRAEAATRLAGGMPQLFGTITISDGISMGTEGMKYSLVSREVIADSIETVCNGQSLDGVLAIGGCDKNMPGAMIAMARMNIPAIFVYGGTIKPGRYKDCDLTVVSSFEAVGQYSAGKISEEDLIGIERNACPGAGSCGGMFTANTMSSIFEAMGMSLPYSSTMAAEDEEKADSTEESAKVLVEAVRKQILPSQILTRKAFENAISVIMAVGGSTNAVLHLLAISRTIGVELSIDDFETIRQRVPVICDLKPSGRYVTVDLHKAGGIPQVMKILLVNGLLHGDALTISGQTIAEILADIPDQPPSGQDVIRPFSNPVYKEGHLAILKGNLATEGSVAKISGVKTPVITGPARVFESEETCLEAILAGKIQAGDVVVVRYEGPVGGPGMREMLAPTSAIIGAGLGDSVGLITDGRFSGGTYGMVVGHVAPEAAVGGTIALVEEGDQITIDARQRLLSLNVSEEELTRRRHHWQPRPPRYKTGILGKFAKLVSSSSLGALTDLNLF

SEQ ID NO: 428 - DNA, 1731 bp, Methylobacterium chloromethanicum
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaggcccaggccgtgaagaagggcgttgccgccgccaagggcaccccgcgcgagttctgcaccatcaccgtcaccgacggcatcgccatgggccatggcggcatgcgtgcctcgctgccgtcgcgcgaggtcatcgccgattcggtcgagctgacgatccgcggccattcctacgacgccctcgtggggctggccggctgcgacaagtccctgcccggcatgatgatggccatggtgcgcctcaacgtgccgtcaatcttcatctatggcggctcgatcctgccgggctcgttccggggccggccggtcacggtgcaggatctgttcgaggcggtcggcaaggtcgccgtcggtgacatgagcctcgacgacctcgacgagctggagcgggtcgcctgcccctcggccggcgcctgcggcgcgcagttcaccgccaacaccatggccaccgtctccgaggcgatcggcctcgcgctgccctactcggccggcgcgcctgccccttatgagatccgcgaccaattctgcgccgccgccggcgagaaggtgatggagctgatcgccaagaacatccgcccgcgcgacatcgtcacccgcaaggccctggagaacgccgctgcgacggtcgcggcctcgggcggttcgaccaacgcggccctgcacctgccggcgatcgcgcatgaatgcggcatcgagttcaccctgttcgacgtcgccgagatcttccgcaagaccccctacatcgccgacctgaagcccggtgggcgctacgtggccaaggacatgttcgaggtcggcggcatcccgctgctgatgaagacgctgctcgaccacggctacctgcacggcgactgcctcaccgtcaccggccgcaccatcgcggagaacctcgccaaggtcgcctggaacccggatcaggacgtcgtgcgcccggccgataagcccatcaccgtcaccggcggcgtggtgggccttcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttttccggcgcgacccgcggcttctgcgtcggccatgtcggccccgaggctgccatcggcgggccgatcggcctgctgcgcgacggcgacatcatcaccctcgacgcgatcaagggcacgctcgacgtggcgctctccgacgaggaactggcccagcgtcgcagcgaatgggcgccgcggggcaatgccgcgacctccggctacctctggaaatatgcgcagtccgtcggacctgcggtgaacggggccgtgacgcatccgggcggcgcgggggagacgaacgtctatgccgacatctag

SEQ ID NO: 429 - protein, 576 aa, Methylobacterium chloromethanicum
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWAPRGNAATSGYLWKYAQSVGPAVNGAVTHPGGAGETNVYADI

SEQ ID NO: 430 - DNA, 9491 bp, artificial sequence
  vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 431 - DNA, 76 bp, artificial sequence
  primer
agtcacatagttaaatggcgctgttcttcgctgcgagcggaaccgggcctggggcgcgtcagcgggtgttggcggg

SEQ ID NO: 432 - DNA, 68 bp, artificial sequence
  primer
ctgatcgttgtttttttttaaataaatgtttatccattctccttacgcatctgtgcggtatttcacac

SEQ ID NO: 433 - DNA, 22 bp, artificial sequence
  primer
gttcttattccctcttgtatcc

SEQ ID NO: 434 - DNA, 20 bp, artificial sequence
  primer
cttggcagcaacaggactag

SEQ ID NO: 435 - DNA, 67 bp, artificial sequence
  primer
ataaccataaccaagtaatacatattcaaactagtatgactgacaaaaaaactcttaaagacttaag

SEQ ID NO: 436 - DNA, 87 bp, artificial sequence
  primer
ctatatcaattaatttgaattaacgcggccgcttaaccacagcaaccaggacaacattttttgccagtttcttcaggcttccaaaag

SEQ ID NO: 437 - DNA, 8946 bp, artificial sequence
  vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcagcatgctagtgaaggccaagttcgtcaagggctttattagagatgttcatccgtatgggtgtaggagagaagtgttaaaccagattgactactgcaagaaagcaattggctttaggggccctaaaaaggttcttattgtaggtgcttcttcaggcttcggactagctactagaatatctgttgcattcggagggcctgaagcccatacaatcggtgtttcatacgagactggagctacagacagaaggataggtacggctgggtggtacaataatatcttctttaaagaattcgctaagaagaaaggtttggtggcaaagaatttcatagaagatgcattttcgaatgaaaccaaggataaagtgataaagtatataaaggacgaatttggtaaaattgatttattcgtatattctttagctgctcctagaagaaaggactacaaaaccggtaatgtttatacctcaagaattaaaacaattctaggtgactttgaagggcctactattgacgtagaaagagatgaaataactttaaagaaggtatcttctgctagtatcgaggaaatcgaagaaacacgtaaagtaatgggcggagaagactggcaggagtggtgtgaggagttattatacgaagattgtttttctgataaagctacaaccatcgcttattcctatattggcagtcctagaacttataaaatatatcgtgaaggaaccattgggattgctaagaaggatttagaagacaaagccaagttgatcaacgaaaagcttaatagagtcataggaggtagggcatttgtgtctgttaacaaagctttagtaaccaaggcatctgcttatattccaaccttccctctatacgctgccatattatataaagtaatgaaagaaaagaacattcacgaaaattgtattatgcaaattgagcgtatgttctcagagaaaatatactccaacgaaaagattcagttcgatgataagggccgtcttagaatggacgatttagaactaagaaaggatgttcaggatgaagttgacagaatttggtctaacataacaccagaaaacttcaaggagcttagtgactacaaggggtataagaaagagtttatgaatctaaatggttttgatttagatggagttgattattccaaggatcttgatattgaattacttagaaaactagagccttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 438 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 439 - DNA, 672 bp, Saccharomyces cerevisiae
agttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaac

SEQ ID NO: 440 - DNA, 270 bp, Saccharomyces cerevisiae
gacctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaa

SEQ ID NO: 441 - skipped

SEQ ID NO: 442 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 443 - protein, 557 aa, Burkholderia ambifaria AMMD PRT
MPYNRRSKHITQGVARSPNRSMYYALGYQKDDFDKPMIGIANGHSTITPCNSGLQRLSDAAVAAVKAADANPQIFGTPTISDGMSMGTEGMKYSLVSREVIADCIETCVQGQWMDGVVVVGGCDKNMPGGMIALARLNVPGIYVYGGTIRPGHWKGRDLTIVSSFEAVGEFTAGRMSQEDFEGVEKNACPTSGSCGGMYTANTMSSSFEALGMSLLYSSTMANPDQEKVDSAAESARVLVEAVKRDLKPRDIITKASIENAVSLIMATGGSTNAVLHYLAIAHAAEIDWTIDDFERIRKRVPVLCDLKPSGQYVATDLHQAGGIPQVLRILLDAGLLHGDCMTITGRTIAEELKDVPGVPRADQKVIFPIDRALYKEGHLAILKGNLAEHGAVAKITGLKNPVITGPARVFDDEQSAMDAILADRIRAGDVLVLRYLGPQGGPGMPEMLAPTSAIIGKGLGESVGFITDGRFSGGTWGMVVGHVAPEAFVGGTIALVQEGDSITIDAHRRVLQLNVDDAELARRRAAWKQPAPRYTRGVLAKYAALARPANQGAVTG

SEQ ID NO: 444 - DNA, 1674 bp, Burkholderia ambifaria
atgccgtacaaccgtcgctcgaagcacatcacgcaaggcgtggcccgttcgccgaaccgctcgatgtattacgccctcggctaccagaaggacgatttcgacaagccgatgatcggcatcgcgaacggccactcgacgatcacgccgtgcaactcgggcctgcagcggctgtcggacgcggccgtcgcggcggtcaaggcggccgacgcgaacccgcagatcttcggcacgccgacgatctcggacggcatgtcgatgggcaccgaggggatgaagtactcgctcgtgtcgcgtgaagtgatcgccgattgcatcgagacctgcgtacagggccagtggatggacggcgtggtggtggtcggcggctgcgacaagaacatgccgggcgggatgatcgcgctcgcgcgcctgaacgtgccgggtatctacgtgtacggcggcacgatccgccccggccactggaagggccgcgacctgacgatcgtgtcgtcgttcgaggcggtcggcgaattcaccgcgggccggatgtcgcaggaggatttcgaaggggtcgagaagaacgcgtgcccgacctcggggtcgtgcggcgggatgtacacggcgaacacgatgagctcgtcgttcgaggcgctcggcatgtcgctgctgtactcgtcgacgatggcgaaccccgatcaggagaaggtcgattcggccgccgaatcggcgcgtgtgctggtcgaggccgtgaagcgcgaccttaagccgcgcgacatcatcacgaaggcatcgatcgagaacgcggtgtcgctgatcatggccaccggcggctcgaccaacgcggtgctgcactatctcgcgatcgcgcacgcggccgagatcgactggacgatcgacgacttcgagcgcatccgcaagcgcgtgccggtgctctgcgacctgaagccgtcgggtcagtacgtcgcgaccgatcttcaccaggcgggcggcatcccgcaggtgctgcgcatcctgctcgatgcggggctgctgcacggcgactgcatgacgatcaccggccgcacgatcgccgaggaattgaaggacgtgccgggcgtgccgcgcgcggaccagaaggtgatcttcccgatcgatcgcgcgctgtacaaggaagggcatctcgcgatcctgaagggcaacctcgcggaacacggcgcggtcgcgaagatcaccggcctgaagaacccggtgatcacgggcccggcccgcgtgttcgacgacgagcaaagcgcgatggacgcgatcctcgccgaccggatccgcgcgggcgacgtgctggtgctgcgctatctcggcccacagggcggccccggcatgccggaaatgctcgcgccgacgtcggcgatcatcggcaaggggctcggcgaatcggtcggcttcatcacggacggccgcttctcgggcggcacctgggggatggtggtcggccacgtcgcgccggaggcgttcgtcggcggcacgatcgcgctcgtgcaggaaggcgattcgatcacgatcgatgcgcaccggcgggtgctgcaactgaacgtcgacgacgcggagctcgcgcgccgccgcgccgcgtggaagcagccggcgccgcgctacacgcgcggcgtgctggccaagtatgcggccctcgcccgcccggcgaaccagggcgccgtcaccggttga

SEQ ID NO: 445 - protein, 574 aa, Bradyrhizobium sp.
MDAKTDIKRRLPSRHVTEGPERAPHRSYLYAMGLTTAQIHQPFVGVASCWNEAAPCNIALMRQAQAVKKGVAHAGGTPREFCTITVTDGIAMGHDGMRSSLPSRETIADSVELTIRGHAYDALVGLAGCDKSLPGMMMAMVRLNVPSIFIYGGSILPGNFRGQQVTVQDMFEAVGKHSVGQMSDDDLDELERVACPSAGACGAQFTANTMATVSEAIGLALPYSAGAPAPYEIRDSFCMTAGEKVMELIAANIRPRDIVTRAALENAAAVVAASGGSTNAALHLPAIAHEAGIKFDLFDVAEIFKKTPYIADLKPGGRYVAKDMFEAGGIPLLMKTLLDHGYLNGDCLTVTGRTIAENLKGVKWNPHQDVVRSADQPITATGGVVGLKGNLAPEGAIVKVAGMSNLKFSGPARCFDREEDAFEAVQKRTYREGDVIVIRYEGPRGGPGMREMLQTTAALTGQGMGGKIALITDGRFSGATRGFCIGHIGPEAAIGGPIALVEDGDIIEIDAVAGRLDVKLSDAELAARKTKWTPRETQHTSGALWKYAQQVGPAVAGAVTHPGGAQEKHCYADI

SEQ ID NO: 446 - DNA, 1725 bp, Bradyrhizobium sp.
atggacgcgaagaccgacatcaagcgcaggctgcccagccgtcacgtgacggaagggcccgagcgtgcgccgcatcggtcctatctctacgcgatgggcctcaccacggctcagatccatcagcccttcgtcggcgtcgcctcgtgctggaacgaggccgcgccgtgtaacatcgcgctgatgcggcaagctcaggccgtcaagaagggcgttgcccacgccggcggcacgccgcgcgagttttgcaccatcaccgtcaccgatggcatcgcgatgggccatgacggcatgcgctcgtcgctgccctcgcgcgagacgatcgctgattccgtcgagctgacgattcgcggtcatgcctacgacgcgctcgtcggtctggccggctgcgacaagtcgctgccgggcatgatgatggcgatggtccggctcaacgtgccgtcgatcttcatctatggcggctcgatcctgcccggcaatttccgcgggcagcaggtcaccgtgcaggacatgttcgaggccgttggcaagcattcggtcggccagatgtcggacgacgatctcgatgagctcgagcgcgtcgcctgtccgtcggccggcgcctgtggcgcgcagttcacggccaacacgatggcgacggtctccgaggcgatcggactggcgctgccctattcggccggggctccggcgccttacgagatccgcgattcgttctgcatgaccgcgggcgagaaggtgatggagctgatcgcggccaacatccggccgcgcgacatcgtcacgcgggcggcgctggagaatgcggcggccgtcgtcgcggcctccggcggctcgaccaacgctgcgctgcacctaccagcgattgcacacgaggcaggtatcaagtttgacctgtttgatgtcgccgaaatcttcaaaaagacaccttatatcgcggatttgaagccaggtggccgctatgtcgccaaagacatgttcgaggctggtggtattccgcttctgatgaagacgttgctcgaccatggctatttgaatggcgactgcctcacagtcaccggccggacgatcgccgaaaacctcaaaggcgtgaaatggaatccgcaccaggacgtggtgaggtcggctgatcagccgatcactgcgaccggtggtgttgtcggtctgaaaggcaatctcgcgccagagggtgcgatcgtgaaagtcgcgggcatgtcgaacttgaaattctctgggccggcccgctgcttcgatcgggaagaggatgcctttgaggcggtgcagaagcggacctatcgcgaaggcgatgtcatcgtcatccgctatgaggggccgcgcggcggtcccggcatgcgggagatgctgcagaccacggcggcgctcaccggacagggcatgggcggcaagatcgcgctgatcaccgacggccggttctcgggcgcgacccgtggcttctgcatcggccatatcggaccggaggccgccatcggggggccgatcgccctcgtcgaagacggcgacattatcgaaatcgacgccgtcgcagggcgtctcgacgtcaagttgagtgatgccgaactcgcggcacgcaagaccaagtggacgccgcgtgagacacagcacacgtcaggtgcgctttggaaatatgcccagcaggtggggccggccgttgcgggcgccgtgacccatccaggtggtgcgcaagagaaacattgctatgcggacatctga

SEQ ID NO: 447 - protein, 658 aa, Delftia acidovorans
MQGGDSRATRSGVNAHREIRRPRYGGRLFSVPRMNQKPASPDNVFSESSASASLAASTATTSTTGSSPAAATPKPTPKPTPKPTPFRSALIRSGTIRATTRSFLHALGQDDEDIERPHIGVFHTGGEMSPCNLNLRDQAQHAKTGIYAGGGTPHECPVVSVSDGLTMAHSGMRFSLVSRELIADSVEASVRGHQWDGIFAIGACDKNLPGLMMGMVRCNVPSVFVHGGSALPGQAPGVHGRDLNVVDTYETIGQVLAGTATAQDLEAMSRACLPTAGACAGQFTANTMGMVSEALGLAPIGSSMVPAVFSERAPLMRRAARQLMQAVWASAEGGGPLPRDIITRRALENACAVVSATGGSTNAALHLPAIAHEAGIRFHLDDVAEIFARTPLIADLRPGGRFLARDVYYIGGAGVILRTLMEQGFVHGDALTFTGRTLAEELADAAPPDGEVVRTPGNPITRDGGLTVLKGNLCPDGALLKTAGLKTLVHRGPARVFESEEQAQAAVQAMQYAAGDVIVIRNEGPRGSPGMREMLGITALLYGQGMGDKVALLTDGRFSGATRGLCIGYAGPEAADNGPIAALRDGDLIAIDARADARSITVEIGEAELAARLEQSAAARRQAPPLGGVLEKYALTVRPAHQGAVTHSGQVVWLRDDS

SEQ ID NO: 448 - DNA, 1977 bp, Delftia acidovorans
ttgcagggcggcgactcccgggcgacacgatctggtgtaaatgctcatagggaaatccgcagaccccgctatggtgggcggctgttttccgtcccgcgtatgaaccagaaacctgcctcccccgacaacgtcttttccgagtccagcgcctccgcatcgctggccgcctccaccgccacaaccagcaccaccggcagcagcccggcagcggccacgcccaagcccacgcccaagcccacgcccaagcccacgccctttcgctccgccctgatccgctccggcaccatccgtgccaccacgcgcagcttcctgcatgccctgggccaggacgacgaagacatagagcgcccgcacatcggcgtgttccacacgggcggggagatgagcccctgcaacctcaacctgcgcgaccaggcccagcatgccaagaccggcatctatgccgggggcggtacgccgcatgaatgcccggtggtgtcggtcagcgacgggctgaccatggcgcattcgggcatgcggttttcgctggtctcgcgcgagttgatcgccgacagcgtggaggcctcggtgcgcggccaccagtgggatggcatcttcgccatcggcgcctgcgacaagaacctgccggggctgatgatgggcatggtgcgctgcaatgtgcccagcgtcttcgtgcatggcggctcggccctgccggggcaggcgcccggcgtgcacgggcgcgacctgaacgtggtcgatacctacgagaccatcggccaggtgctggccggcaccgccacggcgcaggacctggaggccatgagccgcgcctgcctgcccacggccggcgcctgcgcaggccagttcacggccaacaccatgggcatggtgagcgaggcgctgggcctggcgcccatcggctccagcatggtgcccgccgtgttcagcgagcgcgcaccgctgatgcgccgcgccgcgcgccagctcatgcaggccgtgtgggccagcgccgaaggcggcggcccgctgccgcgcgacatcatcacgcgccgggcgctggagaatgcctgcgccgtggtcagcgccacgggcggatcgaccaatgccgccctgcacctgccggccatcgcgcatgaggccggcatccgcttccacctggacgacgtggccgagatcttcgcgcgcacgccgctgatcgccgacctgcgtcccggcgggcgcttcctggcgcgcgatgtgtactacatcggcggcgccggcgtgatcctgcgcacgctgatggagcagggctttgtccacggcgatgcactcaccttcacgggccgcaccctggctgaagaactggccgatgccgcgccgcccgatggcgaggtggtgcgcacgcccggcaatcccatcacgcgcgacggtggcctgaccgtgctcaagggcaacctctgccccgatggcgcgttgctgaagacggccggcctcaagaccctggtgcaccggggccccgcgcgcgtcttcgagtccgaggaacaggcccaggccgccgtgcaggccatgcagtacgcggccggcgatgtcatcgtcatccgcaacgaaggcccgcgcggcagccccggcatgcgcgagatgctgggcatcaccgcgctgctgtatggccagggcatgggcgacaaggtggccctgctgaccgatgggcgcttctctggtgccacgcgcggcctgtgcatcggctacgcaggccccgaggccgccgacaacggccccattgccgcgctgcgcgacggcgacctcatcgccatcgacgcccgcgccgatgcgcgcagcatcacggtggaaatcggcgaggcggaactggccgcacgcctggaacaatcggccgccgcgcgccgccaggccccgccgctgggcggcgtgctggaaaaatacgcgctcaccgtgcgcccggcccaccagggcgcggtcacgcattcgggccaggtggtctggctgcgcgacgacagttga

SEQ ID NO: 449 - protein, 561 aa, Microcystis aeruginosa
MADNYRSRIVTQGTQRSPNRAMLRAVGFGDEDFSKPIIGIANGFSTITPCNMGINDLAMRAEAATRLAGGMPQLFGTITISDGISMGTEGMKYSLVSREVIADSIETVCNGQSLDGVLAIGGCDKNMPGAMIAMARMNIPAIFVYGGTIKPGRYKDCDLTVVSSFEAVGQYSAGKISEEDLIGIERNACPGAGSCGGMFTANTMSSIFEAMGMSLPYSSTMAAEDAEKADSTEESAKVLVEAVRKQILPSQILTRKAFENAISVIMAVGGSTNAVLHLLAISRTIGVELSIDDFETIRQRVPVICDLKPSGRYVTVDLHKAGGIPQVMKILLVNGLLHGDALTISGQTIAEILADIPDQPPSGQDVIRPFSNPVYKEGHLAILKGNLATEGAVAKISGVKTPVITGPARVFESEETCLEAILAGKIQAGDVVVVRYEGPVGGPGMREMLAPTSAIIGAGLGDSVGLITDGRFSGGTYGMVVGHVAPEAAVGGTIALVEEGDQITIDARQRLLSLNVSEEELTRRRNHWQPRPPRYKTGILGKFAKLVSSSSLGALTDLNLF

SEQ ID NO: 450 - DNA, 1686 bp, Microcystis aeruginosa
atggcagataactacagaagtcgcattgttacccaaggtacccaacgcagtcctaatcgggccatgttaagagcggtaggttttggggatgaggactttagcaaaccaatcatcggcatcgctaacggatttagcaccattaccccctgtaacatgggaattaatgatttagcaatgcgtgccgaagcagccacgagattagcggggggaatgccgcaacttttcgggactatcaccattagtgacgggatttccatgggaacagaagggatgaaatattctctcgtttctagggaagtaatcgccgattccattgaaaccgtctgtaatggtcaaagtctcgatggagtcctcgctatcgggggttgtgacaaaaatatgccgggggcaatgattgccatggcccggatgaatattcccgctattttcgtctatggtggcacgattaaaccggggcgctacaaagattgcgatttaaccgtggtcagttcctttgaagccgtgggacagtacagcgccggtaaaatcagtgaagaagacctcatcggaattgaacgcaacgcttgccccggtgctggttcctgtggtggaatgtttactgctaataccatgtcttccatttttgaagccatggggatgagtttaccctattcctcaaccatggccgccgaagatgcggaaaaagccgatagtaccgaagaatcggccaaggttttggtcgaggcggttagaaaacagattctccctagccaaattttgacccgtaaagcctttgaaaacgccatttcggtaattatggcggtgggaggttccactaacgctgtgctgcaccttttagccatttcccgcaccatcggggtagaattatcgatcgatgattttgaaaccatccgccagcgtgtaccggttatctgcgatcttaaaccctccgggcgttacgttaccgtggatctgcacaaagccggcggtattccccaagtgatgaaaattctcctggttaatggtttactgcacggggatgccctcaccattagcggtcagactatcgccgagattttagccgatattcccgaccaaccgccctcaggccaagatgttatccgtccttttagcaatcctgtctataaagagggtcatttagccattttaaaaggaaatctggccacagagggggccgtggccaaaattagcggcgtgaaaactccggtaatcaccggaccggcgcgggtgtttgaatcggaagaaacctgtttagaggcaattttagccggaaaaattcaagccggggatgtggtggttgtccgttacgagggaccagtaggcggaccgggtatgcgggaaatgttggcccccacttcggcaattatcggcgccggtttaggggattccgtgggattaattaccgatggtcgtttttccgggggaacctacggcatggtggtcggtcacgtcgctccagaagcggcggtgggtggtacaattgccctagtagaggagggggatcaaatcactattgatgctcgtcagcgtctcttgagtttaaatgtatcggaagaagaattaacccgtcgtcgtaaccattggcaaccgcgccccccacgctataaaacgggaattctcggcaaattcgccaagttagtctcctctagcagtctcggcgctttaacggatctgaatctgttctaa

SEQ ID NO: 451 - protein, 571 aa, uncultured marine microorganism
MAAISQTRSILAMTTEARSKLKRKSHVVSEGPARAGARAMLRAVGLKDEDMDKPFVAVANLASDVTPCNVHLDRLAQKVKQGVWDANGVPFLFGTITVSDGISMGTEGMKASLVSREVIADSIETVAFAESMDGLIVVAACDKNMPGAIMAMARLNIPALFVYGGTILPGHYRGEDINIQDMYEAVGAYSQGKLTEEELLAMERVACPGEGACAGMFTANTMASAIEALGMSVPGAASIPAVDPRVEDVAHDAGAVLYNLLERDIKPRDILTREALENAITVVLAMGGSTNAVLHLLAIAHEAEVPLDIDDFDRLSSRTPYLTDLRPAGRFVMSDVDKAGGVPVVMRELLKAGLLHGDVMTITGKSLAENLQAFDREPDSRVIYPVSSPRSPTGGLVILKGNLAPEGGVMKVSGTKHHVHEGPARVFDGERAAFDAVTRGDIVDGDVVVVRYEGPKGGPGMQEMLAVTGAIIGQGLGDSVMLLTDGRFSGATHGPMIGHVAPEAAVGGPIALLRDGDTVALNVEARELSVKLSDEEMARRRGEWAAPPPRYQKGVMAKYAKLVSSASVGAV

SEQ ID NO: 452 - DNA, 1712 bp, uncultured marine microorganism
atggcggccataagccaaaccaggagtattttagccatgactaccgaagcaaggtccaaactcaagcgcaagagccacgtggtgagcgaaggcccggccagggccggggcccgcgccatgctccgcgctgtgggcctcaaagacgaggacatggacaagcccttcgtcgccgtggccaaccttgccagcgacgtgacgccctgcaacgtccacctggacaggctggcccagaaggtcaagcagggcgtgtgggatgccaacggtgtacccttcctcttcggcacaataaccgtcagcgatggcatctccatgggcaccgaaggaatgaaggcctccctggtcagccgggaggtcatcgccgattccatcgagacggtggccttcgccgagagcatggacggactgatagtggtcgccgcctgcgacaagaatatgcccggtgccatcatggcgatggcaaggctcaatatcccggcgctgttcgtgtatgggggcaccattcttcccgggcattacaggggcgaagacatcaacatccaggatatgtacgaggccgttggcgcctattcccagggcaagctgacggaggaggagctattggccatggagcgcgtggcctgccctggcgagggggcgtgtgccggaatgttcaccgccaacaccatggcctcggcaatcgaggcgctgggcatgtctgtgccgggcgcggcctccattccggcggtggacccccgcgtcgaggacgtagcccatgacgctggcgcggtgctctacaacctgctggagagggacatcaagccccgtgacatcttaacgcgagaggctctcgagaacgccatcaccgtcgtgctggcaatgggcggttccaccaacgccgttctacacctgctggctatcgcccacgaagccgaagtgcctctggacatagacgacttcgaccgcctcagcagccgcactccctatctcaccgatctccgcccggccgggcgctttgtgatgtctgatgtggacaaggccggcggcgtcccggtggtgatgagggagctgctcaaagcaggtcttctccacggcgatgtgatgaccattacgggcaagagcctcgccgagaacctgcaagccttcgatcgagagcccgacagccgggtgatctaccccgtgtcctcgcctcgcagccccacgggtgggctggtgatcctgaagggcaaccttgcccctgagggtggggttatgaaggtatcggggaccaagcatcacgtccacgaagggccggcccgggtctttgacggcgagcgggccgccttcgacgcggtcacccgaggagatatcgtggacggcgatgtggtggtcgtccggtacgagggccccaagggaggcccgggcatgcaggagatgttggctgtaaccggcgccatcattggtcagggcctgggcgacagcgtcatgcttctaaccgatggtcggttctccggcgcgacccacgggcccatgataggccacgtggcccccgaggccgcggtgggcggccccatcgccctgctgcgggacggtgataccgtcgccttgaacgtcgaggccagggagctgagcgtcaagctctctgacgaggagatggctcggcgtcgcggcgagtgggcggctccccctccgaggtaccagaagggagtgatggccaagtacgccaagctggtgtcgtcggcctctgtcggggcagt

SEQ ID NO: 453 - protein, 557 aa, Burkholderia ubonensis
MSYNRRSKNITQGVARSPNRSMYYALGYRKEDFDKPMIGIANGHSTITPCNAGLQRLSDAAVAAVKDAGANPQIFGTPTISDGMSMGTEGMKYSLVSREVIADCIETCAQGQWMDGVVVVGGCDKNMPGGMIALARLNVPGIYVYGGTIRPGHWKGRDLTIVSSFEAVGEFTAGRMSQEDFEGVEQNACPTTGSCGGMYTANTMSSSFEALGMSLLYSSTMANPDQEKVDSAAESARVLVEAVKRDLKPRDIITRQSIENAVSLIMATGGSTNAVLHYLAIAHAAEVDWTIDDFERIRKRVPVICDLKPSGQYVATDLHQAGGIPQVLKILLDAGLLHGDCMTITGRTLADELKDVSSAPRADQKVIFPIAQALYKEGHLAILKGNLAQDGAVAKISGLKNPVITGPARVFDDEQSAMEAILGDRIHAGDILVLRYLGPQGGPGMPEMLAPTSAIIGKGLGESVGFITDGRFSGGTWGMVVGHVAPEAFVGGTIALVQEGDSITIDAHRLLLQLNVDDAELARRRAAWKQPAPRYTRGVLAKFAALARPANQGAVTG

SEQ ID NO: 454 - DNA, 1674 bp, Burkholderia ubonensis
atgtcatacaaccgccgctcgaagaacatcacgcagggcgtggcccgttcgccgaaccgctcgatgtattacgcgctcggctaccggaaggaagatttcgacaagccgatgatcggcatcgccaacggccattcgacgatcacgccgtgcaacgcgggcctgcagcgcctgtcggacgcggcggtcgcggccgtgaaggacgccggcgcgaatccgcagatcttcggcacgccgacgatctcggacggcatgtcgatgggcacggaggggatgaagtactcgctcgtgtcgcgcgaagtgatcgccgactgcatcgaaacctgcgcgcagggccagtggatggacggcgtggtcgtcgtcggcggctgcgacaagaacatgccgggcgggatgatcgcgctcgcgcgcctgaacgtgccgggcatctacgtgtacggcggcacgatccgcccgggccactggaagggccgcgacctgacgatcgtgtcgtcgttcgaggcggtcggcgagttcaccgcgggccggatgtcgcaggaggatttcgaaggggtcgagcagaacgcgtgcccgacgacgggctcgtgcggcggcatgtacaccgcgaacacgatgagctcgtcgttcgaggcgctcggcatgtcgctgctgtattcgtcgacgatggcgaacccggaccaggaaaaggtcgactccgcggccgaatcggcgcgcgtgctggtcgaagcggtcaagcgggacctgaagccgcgcgacatcatcacgaggcagtcgatcgagaacgcggtgtcgctgatcatggcgaccggcggctcgaccaacgcggtgctgcactatctggcgatcgcgcacgcggccgaggtcgactggacgatcgacgatttcgagcgcatccgcaagcgcgtgccggtgatctgcgacctgaagccgtcgggccagtacgtcgcgaccgacctgcaccaggccggcggcattccgcaggtgctgaagatcctgctcgacgccggcctcctgcacggcgactgcatgacgatcacgggccgcacgctcgccgacgagctgaaggacgtgtcgagcgcgccgcgcgcggaccagaaggtgatcttcccgatcgcgcaggcgctgtacaaggaaggccacctcgcgattctgaagggcaacctcgcgcaagacggcgcggtcgcgaagatctccggcctgaagaacccggtcatcacgggcccggcgcgcgtgttcgacgacgagcagagcgcgatggaggcgatcctcggcgaccggatccacgccggcgacatcctcgtgctgcgctacctcggcccgcagggcggcccggggatgccggagatgctcgcgccgacctcggcgatcatcggcaagggcctcggcgaatcggtcggcttcatcaccgacggccggttctccggcggcacctgggggatggtggtcggtcacgtcgcgccggaggcgttcgtcggcggcacgatcgcgctcgtgcaggaaggcgattcgatcacgatcgacgcgcaccggctgctgctgcagttgaatgtcgacgatgccgaactggcgcgccgccgcgctgcatggaagcagcccgcgccgcgctacacgcgcggcgtgctcgcgaagttcgccgcgctcgcccgcccggcgaaccagggcgccgtcaccggctga

SEQ ID NO: 455 - protein, 560 aa, Gemmata obscuriglobus
MSDGPTRTSLITTGGQGRAPNRAMLRAVGFTDEDFDRPVIGVASLFSDITPCNAHLNRLAEKGREGVRAAGGVPQTFGAPTVSDGISMGHRGMRYSLVSREVIADAIETVCGAMNHDGLVAFGGCDKNMPGCVMAMARLNIPSVFVYGGSIMPGVGAHGEDLDIVSIFEAVGQFQAGKIDQKALHKVECESCPGHGSCGGMYTANTMSSAIEAMGLSLPYGASNPAVTAAKDRESFLAGKAVLRCVEKNIRPRDIITRKSLENAYTFVLALGGSTNAVLHLMAIAREAGVEWTLEDFDRISAKTPHLADLKPGGKYVMFDLYRVGGTPAVLKALLDNGFLHGDCITVTGQTLAENLKDVPSVFEKPQKVVKRFEEPLFSHGIHVVLKGNLAPEGAVAKVAGLKQRSITGPAKVFDGEEACFAAIQARKIVAGDVVVIRGEGPVGGPGMREMLSITGALMGQGLGETVGLITDGRFSGGTHGLVVGHVAPEAWVGGPIALIHDGDSITIDGDAKTLTLNIPDAELQARKDQWKAPALRVTGGVLAKYAKLARSASEGAGTG

SEQ ID NO: 456 - DNA, 1683 bp, Gemmata obscuriglobus
atgtctgatggtcccacccgtaccagcctgatcaccaccggcggccagggccgcgcgccgaaccgcgcgatgctccgggcggtcgggttcaccgacgaggacttcgaccggccggtgatcggggtcgcgtcgctgttcagcgacattaccccgtgcaacgcgcacctgaaccggctcgcggagaaggggcgcgagggggtgcgcgccgccggcggcgtcccccagacgttcggcgcgccgaccgtgtccgacgggatcagcatggggcaccgcgggatgcggtactcgctggtgagccgcgaggtgatcgcggacgccatcgagaccgtgtgcggggcgatgaaccacgacgggctggtcgcgttcggcgggtgcgacaagaacatgcccggctgcgtcatggcgatggcccggctcaacatcccgagcgtgttcgtctacggcggcagcatcatgccgggcgtcggggcgcacggcgaggacctcgacatcgtctcgattttcgaggccgttggtcagttccaggcgggcaagatcgaccaaaaggcgctccacaaggtggagtgcgagagttgcccgggtcacggctcgtgcggcggcatgtataccgccaacacgatgtccagcgcgatcgaagcgatgggcctgtcgctgccttacggggcgagcaacccggcggtgaccgccgcgaaggaccgcgagtcgttcctggccggtaaggcggtgttgcggtgcgtcgagaagaacatccgcccgcgcgacatcatcacccgcaagagcctggaaaacgcctacacattcgtgttggctctgggcggcagtacgaacgcggtgctgcacctgatggcgatcgcgcgtgaggcgggcgtcgagtggacgctcgaggacttcgaccgcatcagcgcgaagacgccgcacctcgcggacctgaagccgggcggcaagtacgtgatgtttgacctgtaccgcgtgggcggcacgcccgcggtgctgaaggcattgctggacaacggcttcctgcacggcgactgcatcaccgtgaccggccagacgctcgcggagaacctcaaagacgtgcccagcgtgttcgagaagccgcagaaagtggtaaagcggttcgaggagccgctcttcagccacgggattcacgtggtgctgaagggcaacttggcgcccgaaggagcggtcgcgaaggtggcaggcctgaagcaacgcagcatcaccggcccggccaaggtgttcgacggcgaggaggcgtgtttcgccgccatccaggcgcggaagatcgtcgcgggcgatgtggtcgtgatccgcggtgaggggccggtcggcggtcccgggatgcgcgagatgctgagcatcaccggcgcgctaatgggccaggggctgggcgagacggtggggctcatcaccgacggccggtttagtggtggtacgcacgggctggtggtcggacacgtcgcgcccgaggcctgggtgggtggcccgatcgcactcatccacgacggcgactcgatcaccatcgacggcgacgccaagaccctcacgctcaacattcctgacgcggaactgcaagcgcggaaggatcagtggaaggcgccggcgctgcgggtgacgggcggggtgttggcgaagtacgcgaagctggcccgctctgccagcgaaggcgccgggaccgggtga

SEQ ID NO: 457 - protein, 578 aa, Mycobacterium abscessus
MSAPHKPDSLRASGSSQPDIKPRSRDVTDGLEKTAARGMLRAVGMGDDDWVKPQIGVGSSWNEITPCNMSLQRLAHSVKDGVHEAGGYPLEFGTISVSDGISMGHEGMHFSLVSREVIADSVETVMQAERLDGSVLLAGCDKSIPGMLMAAARLDLASVFLYNGSIMPGKAKLTDGTEKEVTIIDAFEAVGACARGLMSREDVDIIERAICPGEGACGGMYTANTMASAAEALGMSLPGSASPVAIDKRREEYARKSGEAVVEMLRRGITARDILTKEAFENAIAVVMAFGGSTNAVLHLLAIAKEAEVELSLADFTRIGNKVPHLADVKPFGRHVMKDVDEIGGVPVVMRALLDAGLLHGDCLTVTGKTMAENLAHIAPPDPDGKVLRAMNDPIHPTGGITILHGSLAPEGAVVKSAGFESDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVANGKLDLLVDEAEIAERRKGFEPLPPRYKTGVLAKYTKLVQSAAVGAVCG

SEQ ID NO: 458 - DNA, 1737 bp, Mycobacterium abscessus
atgtcagccccgcacaagcctgattctcttcgcgcaagcggctcatcgcagcccgatatcaagccccgtagccgcgacgtcaccgacggcctggagaagaccgccgcccgcggaatgctgcgcgcggtaggcatgggcgacgacgactgggtcaaaccgcagatcggtgtcggctcgtcctggaacgaaatcaccccgtgcaacatgtcgctgcaacggctggcgcattcggtgaaggacggcgtgcacgaggccggtggctatccgctggagttcggcaccatctcggtgtccgacggcatctccatggggcacgagggcatgcacttctcgctggtttcacgcgaagtcatcgccgacagcgtcgagaccgtgatgcaggccgagcgcctcgatggatccgtgctgctggccggatgcgataagtcaatacccggaatgctcatggccgcagcacgtttggacttggcctcggtgttcttgtacaacggctcgatcatgccgggcaaggccaagttgaccgacggtactgagaaggaagtcaccatcatcgacgccttcgaggcggtcggcgcctgcgcgcgcgggctgatgtcacgcgaggacgttgacatcatcgaacgcgccatctgtccgggtgagggcgcctgcggcggcatgtacaccgccaacaccatggccagcgccgccgaggcgctgggaatgtccttgccgggcagcgcctctccggtcgccatcgacaagcgccgcgaggagtacgcacgcaagtccggcgaggctgtcgtcgagatgctgcgccgcgggatcaccgcgcgcgacatcctcaccaaggaggccttcgagaacgccatcgccgtggtgatggcgttcggcggctccaccaacgcggtgctgcatctgctggccatcgccaaagaggctgaggtcgaactgtcgctggccgacttcactcgcatcggcaataaggtgccgcatctggcagacgtcaaaccctttggccgccacgtgatgaaggatgtcgacgagatcgggggcgtgcccgtggtgatgcgcgcgctcttggatgccggcctgctgcacggcgattgcctgaccgtcaccggcaagacaatggccgagaacctggcgcatatcgccccaccggacccggacggcaaggtgctacgtgccatgaacgacccgatccacccgaccggcggcatcaccatcctgcacggttcattggctcccgagggagccgtggtgaagtcggccggcttcgaatccgacgtcttcgagggcaccgcaagggttttcgagcgcgaacgagcggccctggacgcgctcgaggacggcaccatcactcatggcgacgtcgtcgtgatccgctatgaaggccccaagggcggccccggcatgcgcgagatgctggcgatcaccggagccatcaagggcgccggcctgggcaaggatgtgctgctgatgaccgacgggcgcttctccggcgggaccaccggcctctgcgtcgggcatatcgctccagaagccgtggacggcggacccatcgcctttgtccgggacggtgaccggatccgcctcgatgtcgcgaacggcaagctcgacctgctggtcgacgaggccgagatcgccgagcgccgtaaggggttcgaaccgctaccgccgcgctacaagacgggcgtgctggccaagtacaccaagctggtgcagtcggcggcggtcggcgcggtctgcggctaa

SEQ ID NO: 459 - protein, 561 aa, Synechococcus sp.
MSDNRRSRVVTEGHQRSPNRAMLRAVGFGDDDFSKPIVGLANGYSTITPCNMGINDLAQRADKAIREAGAMPQMFGTITISDGISMGTEGMKYSLVSRDVIADSIETACNGQSMDAVLAIGGCDKNMPGAVLAIARMNIPAIFVYGGTIKPGHLDGEDLTVVSAFEAVGEFSAGKIDEERLLAVEKNACPGAGSCGGMYTANTMSSAFEAMGISLPYSSTMAAEDEEKAVSAEESARVLVNAIKKQILPKDILTRKAFENAISVIMAVGGSTNSVLHLLAIANTIGVDLTIDDFETIRQRVPVICDLKPSGRYVATDLHKAGGIPQVMKMLLDHGLLHGDCLTITGKTVAETLADIPSEPSPDQDVIRPWDKPMYEKGHLAILKGNLAEEGSVAKISGVKNPRITGPARVFESEEECLDAILAGKIVAGDVVIVRYEGPKGGPGMREMLAPTSAIIGAGLGDSVGLITDGRFSGGTYGLVVGHVAPEAFVGGNIALVEEGDSITIDAHEKLLQINVPDEELAKRRAAWKPREPRYKRGVLGKYAKIVSTSSKGAVTDIDLF

SEQ ID NO: 460 - DNA, 1686 bp, Synechococcus sp.
atgagcgacaatcgacgtagccgggtagtcaccgaaggtcatcagcggagcccaaaccgcgccatgctccgggctgtgggctttggggatgatgattttagtaaaccaattgtgggcttggcgaatgggtacagtacgattacgccatgcaatatgggaatcaatgacctcgcccagcgagcggataaggcaatccgggaagcgggagcgatgccgcagatgtttgggacgatcaccattagtgatgggatctccatgggtacggaggggatgaagtattctttggtttcccgtgatgtgatcgctgactccattgagacggcttgtaatggccaaagcatggatgcggttctcgccattggcggttgtgataagaatatgccgggggcagtgttggcgatcgcccggatgaatatccccgcaatttttgtttacggtggcacgatcaaacccggtcatttagacggggaagatctcacagttgttagtgcgttcgaggctgtcggtgaatttagcgccggaaaaatcgacgaggaaagattattagccgttgagaaaaatgcttgtccgggggctggctcctgtggcgggatgtacacggccaatacgatgtcctcggcttttgaggcgatggggatcagtttgccctactcctcgacgatggccgctgaagatgaagaaaaagctgtcagtgcggaagagtcggcacgcgttttggtcaatgcgatcaagaagcagattttgccgaaggacatcctcacgcgcaaggcatttgaaaacgcgatttccgtaattatggccgtgggcggctcgacaaattcagtcttacatttgttggcgatcgccaatactatcggtgtggatctgaccatcgacgactttgaaaccatccgccagcgcgtccccgtcatctgtgacctcaagccctctggtcgctacgttgccaccgatctccacaaggcgggcggcattccccaggtgatgaaaatgctcttggatcacggtcttctccatggcgactgtctaacaattactggcaaaaccgtcgctgaaaccctcgccgatattcccagcgaaccctctcccgatcaggatgtgattcgtccttgggataagccaatgtacgaaaaaggacacctggcgatcctcaagggcaacttggccgaagaaggttccgtggcgaaaattagtggcgtgaaaaatccccggatcactggccccgcccgcgtttttgagtccgaagaagaatgtctcgatgcaatcctggctggcaagattgttgctggtgatgtggtgattgttcgttacgaagggccgaagggtggccccgggatgcgggaaatgctagcgcccacctccgcaattattggcgctggtctgggcgattctgtcggtctgatcaccgatggtcgtttctctggcggaacctatggtctcgtggtcggacacgttgccccggaagcgtttgtgggtggcaatattgcccttgtggaagaaggggacagcatcaccatcgatgcccacgaaaaactgttgcaaatcaatgttcctgatgaggaactggcaaaacgtcgcgccgcttggaaaccccgtgaaccccgttataagcgtggtgtccttggaaagtatgccaagattgtttccaccagtagtaaaggtgcagtgacagatatcgatttgttttaa

SEQ ID NO: 461 - protein, 557 aa, Burkholderia graminis
MPYNRRSKNITQGVARSPNRSMYYALGYQKEDFDKPMIGIANGHSTITPCNAGLQRLADAAVAAVKGTDANPQIFGTPTISDGMSMGTEGMKYSLVSREVIADCIETCVQGQWMDGVVVIGGCDKNMPGGMIGLARMNVPGIYVYGGTIRPGNWKGTDLTIVSSFEAVGEFTAGRMSEEDFEGIEKNACPSTGSCGGMYTANTMSSSFEALGMSLLYSSTMANPDHEKVDSAAESARVLVEAVKKDLKPRDIITKKSIENAVALIMATGGSTNAVLHYLAIAHAAEVEWTIEDFERIRKKVPVICNLKPSGQYVATDLHKAGGIPQVMKILLDAGLLHGDCITITGKTLAEELKDVPGKPRADQQVIFPIEKALYKEGHLAILKGNLAEDGAVAKITGLKNPVITGPARVFDDEQSALEAILADRIVAGDVVVLRYLGPKGGPGMPEMLAPTSAIIGKGLGESVGLITDGRFSGGTWGMVVGHVAPEAFVGGTIGLVQEGDSITIDAHRLLLQLNVDDAELQRRRAAWQQPKPRYTRGVLAKYSALALPANKGAVTG

SEQ ID NO: 462 - DNA, 1674 bp, Burkholderia graminis
atgccatacaaccgtcgttcgaagaacatcacgcaaggcgtggcccgttcgccgaaccgctcgatgtactacgcactcggctatcagaaggaagacttcgacaagccgatgatcggcatcgcgaacggccattcgacgatcacgccatgcaacgccggcctgcagcgtcttgccgacgccgccgtcgccgcggtcaagggcacggacgcgaatccgcagatcttcggcacgccgaccatctcggacggcatgtcgatgggcaccgaaggcatgaagtactcgctcgtctcacgcgaagtgatcgccgactgcatcgagacctgcgtacaaggtcagtggatggacggcgtggtcgtgatcggcggctgcgacaagaacatgcccggcggcatgatcggcctcgcgcgcatgaacgtgccgggcatctacgtgtatggcggcacgatccgtccgggcaactggaagggcaccgatctgaccatcgtgtcgtcgttcgaggcggtcggcgaattcacggcgggccgcatgtcggaagaggacttcgaaggcatcgagaagaacgcgtgcccgtcgacgggttcgtgcggcggcatgtacacggccaacacgatgagctcgtcattcgaagcgctcggcatgtcgctgctgtattcgtcgacgatggcgaaccccgaccacgaaaaggtcgactcggccgctgagtcggcgcgcgtgctcgtcgaagccgtcaagaaagacctgaagccgcgcgacatcatcacgaagaagtcgattgaaaacgccgtcgcgctgatcatggcgacgggcggctcgaccaacgcggtgctgcactatctggcgatcgcgcacgcggctgaagtggaatggacgatcgaggacttcgagcgcatccgcaaaaaagtgccggtgatctgcaatctgaaaccatcgggccagtacgtcgcgaccgacctgcacaaggccggcggcattccacaggtcatgaagattctgctcgacgcgggtctgttgcatggcgactgcatcaccatcacgggcaagacgctcgccgaagaactgaaggacgtgccgggcaagccgcgcgccgatcagcaggtgatcttcccgatcgagaaggcgctgtacaaggaaggccatctcgcgatcctgaagggcaatctcgccgaagacggcgcggtggcgaagatcacgggcctgaagaacccggtgatcaccgggccggctcgcgtgttcgacgacgagcaaagcgcgctcgaagcgattctggccgataggatcgttgccggcgatgtcgtcgtgctgcgctatctcggcccgaagggcggtccgggcatgccggaaatgctcgcgccgacgtcggcgattatcggcaaagggctcggcgaaagcgtcggcctcatcaccgacggacgcttttcgggcggcacatggggcatggtggtcggccacgtcgcgccggaagcgttcgtcggcggcacgatcgggctcgtgcaggaaggcgattcgatcaccatcgacgcacacaggttgctcttgcaactgaacgtcgacgacgccgaattgcagcgccgccgcgccgcctggcagcagccgaagccgcgctacacgcgcggcgtgctggcgaagtactcggcgctggcgttgccggccaacaagggggcggtcaccggttga

SEQ ID NO: 463 - protein, 576 aa, Methylobacterium radiotolerans
MVTRLNDKSKLPSRHVTEGPDRAPHRSYLYAMGLTREQIHQPLVGVASCWNEAAPCNISLMRQAQAVKKGVAAANGTPREFCTITVTDGIAMGHGGMRASLPSREVIADSVELTMRGHAYDALVGLAGCDKSLPGMMMAMVRLNVPSIFIYGGSILPGSFRGKPVTVQDLFEAVGKVAVGDMSLEDLDELEQVACPSAGACGAQFTANTMATVSEAIGLALPYSAGAPAPYEIRDKFCATAGEKVMELLEKRIRPRDIVTRKALENAATVVAASGGSTNAALHLPAIAHECGIEFTLFDVAEIFRRTPYIADLKPGGRYVAKDMFEVGGIPLLMKTLLDHGFMHGDCMTVTGRTIAENMDRVTWNPDQDVVYPANRPITPTGGVVGLKGNLAPEGAIVKVAGIPAEKQVFTGPARVFDGEEACFAAVQARSYKEGDVLVIRYEGPRGGPGMREMLSTTAALYGQGMGDKVALITDGRFSGATRGFCVGHVGPEAAVGGPIGLLRDGDVITLDAIQGTLSVALSDAELAERRKAWTARPNTATSGYLWKYAQGVGPALYGAVTHPGGAKETQSYADV

SEQ ID NO: 464 - DNA, 1731 bp, Methylobacterium radiotolerans
atggtgacgcgtttgaacgacaagtcgaagctgccgagccgccacgtcacggaggggcccgaccgcgccccgcaccgctcctacctctacgccatgggcctgacccgcgagcagatccaccagccgctggtgggtgtcgcctcgtgctggaacgaggccgcgccctgcaacatctcgctgatgcgccaggcgcaggcggtgaagaagggcgtcgccgccgccaacgggacgccgcgcgagttctgcacgatcaccgtcaccgacggcatcgccatgggccacggcggcatgcgcgcgtcgctgccgtcgcgggaggttatcgccgactcggtcgagctgaccatgcgcggccacgcctacgacgccctcgtgggtctggcgggctgcgacaagtcgctgcccggcatgatgatggcgatggtccgcctgaacgtgccctcgatcttcatctacggcggctcgatcctgccgggctcgttccgtggcaagcccgtgaccgttcaggacctgttcgaggcggtcggcaaggtggccgtcggcgacatgagcctcgaggatctcgacgagctggagcaggtcgcctgcccgtcggccggcgcctgcggcgcgcagttcaccgccaacaccatggcgaccgtctccgaggcgatcggcctggcgctgccgtactcggccggcgccccggccccctacgagatccgcgacaagttctgcgcgaccgccggcgagaaggtgatggagcttctggagaagcgcatccgcccgcgcgacatcgtcacccgcaaggccctggagaacgccgccacggtggtggcggcctcgggcggctcgaccaacgcggcgctgcacctgccggcgatcgcgcacgagtgcggcatcgagttcacgctgttcgacgtggccgagatcttccggcgcacgccctacatcgccgacctgaagcccggcgggcgctatgtcgccaaggacatgttcgaggtcggcggcatcccgctgctgatgaagacgctcctcgaccacggcttcatgcacggcgactgcatgacggtcaccggccgcaccatcgcggagaacatggaccgggtgacctggaacccggaccaggacgtggtctacccggccaaccgcccgatcaccccgaccggcggcgtcgtcggcctcaagggcaacctcgcccccgagggcgcgatcgtgaaggtcgccggcatcccggccgagaagcaggtcttcaccggcccggcccgcgtgttcgacggcgaggaggcctgcttcgcggccgtgcaggcgcgcagctacaaggaaggcgacgtcctcgtgatccgctacgagggtccgcggggcggccccggcatgcgcgagatgctgtcgaccaccgcggccctctacggccagggcatgggcgacaaggtcgcgctgatcaccgacgggcgcttctcgggcgcgacccggggcttctgcgtcggccatgtcggccccgaggccgccgtgggcggcccgatcgggctgctccgcgacggcgacgtgatcaccctcgacgcgatccagggcacgctcagcgtcgccctgtccgacgcggaactggccgagcgccgcaaggcctggaccgcgcggcccaacaccgcgacctccggctacctctggaaatacgcgcagggcgtcggcccggccctgtacggcgccgtcacccatccgggaggtgccaaggagacgcagagctatgcggacgtctag

SEQ ID NO: 465 - protein, 560 aa, Leptothrix cholodnii
MSFNRRSKNITEGVARAPNRSMYYALGYQQDDFSKPMIGVANGHSTITPCNSGLQKLADAAVIGIKEAGGNPQIFGTPTISDGMAMGTEGMKYSLVSREVIADCVETCVGGQWMDGVIVIGGCDKNMPGGMMGMLRANVPALYVYGGTILPGKYKGQDLNIVSVFEAVGQFSAGKMAEEDFCEIERRAIPGSGSCGGMYTANTMSSSFEALGMSLPYSSTMANVEEEIVASVKVAAGVLVEAVKADLKPRDIVTKKAIENAVAVIMATGGSTNAVLHFLAIAHAAEVEWTIDDFERVRRRTPVLCDLKPSGKYLAIDLHHAGGIPAVMKELLKHGLLHGDCMTITGKTVAENLADVPDLRADQDVIRAVTNPIYAEGHLAILKGNLSPEGCVAKITGLKSPVMTGPARVFEDEQSALAAIMANKIVAGDVMVLRYLGPKGGPGMPEMLAPTGALIGQGLGESVGLITDGRFSGGTWGMVVGHVAPEAYAGGNIALVQEGDSITIDAHQLLLQLNVSDDELARRRAAWTAPAPRYTRGVLAKFAFNASSASAGAVLDKFGG

SEQ ID NO: 466 - DNA, 1683 bp, Leptothrix cholodnii
atgagcttcaaccgccgctccaagaacatcaccgaaggcgtcgcgcgcgccccgaaccgctcgatgtactacgcgctgggctaccagcaggacgacttcagcaagccgatgatcggcgtggccaacggtcactcgaccatcacgccgtgcaactcgggcctgcagaagctggccgacgccgcggtgatcggcatcaaggaagccggcggcaacccgcagatcttcggcacgccgacgatttcagacggcatggcgatgggcaccgagggcatgaagtactcgctggtgtcgcgcgaggtgatcgccgactgcgtcgagacctgcgtgggcggccagtggatggacggcgtgatcgtcatcggcggctgtgacaagaacatgcccggcggcatgatgggcatgctgcgcgccaacgtgccggcgctgtacgtctacggcggcaccatcctgccgggcaagtacaagggccaggacctcaacatcgtcagcgtgttcgaggccgtgggccagttctcggccggcaagatggccgaagaggatttctgcgagatcgagcgccgcgccatccccggctcgggttcatgcggcggcatgtacaccgccaacacgatgagttcgtcgttcgaggcgctgggcatgagcctgccgtactcgtcgacgatggccaacgtggaggaagagatcgtcgccagcgtcaaggtggcggccggcgtgctggtcgaggcggtcaaggccgacctgaagccgcgcgacatcgtcaccaagaaagcgatcgagaacgccgtcgccgtgatcatggccaccggcggctcgaccaacgcggtgctgcatttcctggcgatcgcccacgccgccgaagtcgagtggacgatcgacgacttcgagcgcgtgcgccgccgcacccccgtgctgtgcgacctgaagcccagcggcaagtacctggcgatcgacctgcatcacgccggcggcatcccggcggtgatgaaggaactgctcaagcacggcctgctgcacggcgactgcatgaccatcaccggcaagaccgtggctgaaaacctggccgacgtgcccgacctgcgcgccgaccaggacgtgatccgcgcggtcacgaacccgatctacgccgaaggccacctggcgatcctgaaaggcaacctcagccccgaaggctgcgtcgccaagatcaccggcctgaagagcccggtcatgaccggcccggcacgcgtgttcgaggacgaacaatcggcactcgccgcgatcatggccaacaagatcgtcgccggtgacgtgatggtgctgcgctacctcggccccaagggcggcccgggcatgcccgagatgctggcgcccaccggcgcgctgatcggccagggcctgggcgagagcgtcggcctgatcaccgacgggcgtttttcgggcggcacctggggcatggtggtcggccacgtcgcgcccgaggcctatgcgggcggcaacatcgcgctggtgcaggagggtgactcgatcaccatcgacgcccaccagctgctgctgcagctcaacgtcagcgacgacgaactggcccgccgccgcgccgcctggacggcgccggcgccgcgctacacccgcggcgtgctggcgaagttcgcgttcaacgcttcgagcgcgagcgccggtgcggtgctcgacaagttcggcggctga

SEQ ID NO: 467 - protein, 580 aa, Verrucomicrobium spinosum
MPPKSSAKSKAKSAASSELHRKHSAIVVDGVERAASRAMLHAVGFKRDDFKKSVIGIASTWSMVTPCNMHIDRLAKEAAKGADAAGGKSIIFNTITISDGISMGTEGMKYSLVSREVIADSIETVVGCEGMDGFVAIGGCDKNMPGCVIAMARLNRPSVFVYGGTILPGCVGPEKKESDIVTVFEAVGKHANCLIGDKELEDIEEHAIPGEGSCGGMYTANTMASAIEAMGLSLPNSGAQSAVSDDKLRDCFDAGAAVLNMIKLGITPRDIITKESFENAITLIITLGGSTNAVLHLIAMAHSAGVKLSIEDFVRIGKKTPVLADLKPSGKYFMNDLVKIGGTVPLMKILVEEGLMHGDCLTVTGRTMKENLSKIKLIYPKSQNIIYPLSNPIKKDSHLVIFKGNLCPEGAVGKISGKEGLVFNGKAIVFESEEKALDAILNDKVKKGHVIVIRMEGPKGGPGMREMLSPTSAIMGKGLGKDVALITDGRFSGGSHGFVVGHVTPEAFVGGPIAVIKNGDPITIDAEKRAITLGIPAKELQARLKAWKQPKPRYTRGVLAKYAATVTSASEGAVTDKDVV

SEQ ID NO: 468 - DNA, 1743 bp, Verrucomicrobium spinosum
atgcctcccaaatcgtccgcgaaatcgaaagcgaagtccgccgcctcctctgaactgcatcgcaagcactccgccatcgtcgtggacggcgtggagcgcgccgccagccgcgccatgctgcacgccgtgggcttcaagcgggacgactttaagaagtcggtcatcggcatcgcctccacctggagcatggtcaccccgtgcaacatgcacatcgaccgcctggccaaagaggccgccaagggcgctgacgccgccgggggcaagagcatcatcttcaacaccatcaccatctccgacggcatctccatgggcacggaggggatgaaatactccctcgtgagccgcgaggtcatcgccgactccatcgagaccgtggtgggctgcgagggcatggacggcttcgtcgccatcggcggctgcgacaaaaacatgcccggctgcgtgatcgccatggcccggctcaaccgccccagcgtcttcgtttacggcggcaccatcctccccggctgcgtgggccccgagaagaaggaaagcgacatcgtcaccgtgttcgaggccgtgggcaagcacgccaactgcctcatcggcgacaaggagctggaagacatcgaagagcacgccatccccggggaaggctcctgtggcgggatgtacacggcgaacaccatggccagcgccatcgaggccatgggcctgagcctgcccaacagcggcgcgcaatccgccgtgtccgacgacaagctgcgcgactgtttcgacgccggcgctgccgtgctgaacatgatcaagctgggcatcaccccgcgtgacatcatcaccaaggagtcgtttgaaaacgccatcaccctcatcatcaccctgggcggctccaccaacgccgtgctgcacctcatcgccatggcccactccgccggcgtgaagctcagcattgaggacttcgtccgcatcggcaagaagaccccggtcctggccgacctcaagcccagcggcaagtacttcatgaacgacctcgtgaagatcggcggcaccgtgccgctcatgaagatcctcgtggaagaaggcctcatgcacggcgactgcctcaccgtcaccggccgcacgatgaaggagaacctcagcaagatcaaactgatctaccccaagagccagaacatcatctacccgctgagcaacccgatcaaaaaagacagccacctggtcatctttaaagggaacctctgccctgagggtgccgtcggcaagatcagcggcaaggaaggcctcgtcttcaacggcaaagccatcgtgttcgagtccgaggagaaggcgctggacgccatcctcaatgacaaggtgaaaaaaggccacgtcatcgtcatccgcatggaaggaccgaagggcggccccggcatgcgcgagatgctgagccccaccagtgccatcatgggcaagggcctgggcaaagacgtcgccctcatcaccgacggccgtttcagcggcggcagccacggcttcgtggtcggccacgtcaccccggaggccttcgtgggcggtccgattgccgtcatcaagaacggcgaccccatcaccatcgacgccgaaaaacgcgccatcaccctgggcattcccgccaaggaactgcaagcccgcctcaaagcctggaagcagcccaagccccgctacacccgtggcgtgctggccaagtacgccgccaccgtcaccagcgccagcgaaggcgcggtcacggacaaggacgtggtgtaa

SEQ ID NO: 469 - protein, 561 aa, Cyanothece sp.
MSENLRSRAVTQGSQRTPNRAMLRAVGFGDDDFNKPIVGVANGFSTITPCNMGINDLAKRAEAGIKSAGGMPQMFGTITISDGISMGTEGMKYSLVSRDVIADSIETACNGQSMDGVIAIGGCDKNMPGAMIAMARMNIPAIFVYGGTIKPGHYNGEDLTVVSAFEAVGQHSAGKIDDNTLLAIERNACPGAGSCGGMFTANTMSSAFEVMGMSLPYSSTMAAEDAEKADSTEKSAFVLVNAIRNQILPRQILTRKAFENAVSVIMAVGGSTNAVLHLLAIANTIGVDLTLDDFETIRQRVPVLCDLKPSGRYVTVNLHQAGGIPQVMKMLLNHGLLHGDALTISGQTIAEILADVPDEPPANQDVIRSWDNPVYKEGHLAILKGNLASEGAVAKISGVKNPQITGPARVFESEEECLEAILAGKINAGDVIIVRYEGPRGGPGMREMLAPTSAIIGAGLGDSVGLITDGRFSGGTYGLVVGHVAPEAYVGGTIGLVEEGDSITIDAKKKLLQVNVSEEELSQRRANWKAPEPRYQRGVLGKYAKLVSSSSLGAVTDLNLF

SEQ ID NO: 470 - DNA, 1686 bp, Cyanothece sp.
atgtctgaaaatttaagaagccgtgctgttacccaaggaagtcaaagaactcctaaccgtgccatgttgagggctgtcggcttcggagacgatgactttaataagcctattgttggggtagcgaatggcttcagtaccattaccccttgtaacatggggattaatgacttagccaaacgggctgaagcagggattaaaagtgcgggcggtatgcctcaaatgttcggtacgattactatcagtgatggtatttctatgggaacagaaggcatgaaatattccctagtgtcacgggatgtcattgccgactccattgaaaccgcttgtaatggtcaaagcatggatggggtgatcgctattggtggatgtgataagaatatgccaggggcgatgatagccatggcaaggatgaatatacctgctatttttgtctatggaggaactattaaacccggtcattacaacggggaagatttaacggtggttagtgcctttgaagcggttggccaacatagcgctggtaagattgatgataacacactactagccattgaacgcaacgcctgtcctggtgccgggtcctgtggaggaatgttcaccgccaataccatgtcttcggcttttgaagtgatgggtatgagtttgccctactcgtctacaatggctgcagaagatgcagaaaaagcagatagtaccgaaaagtcagcctttgtattagtaaatgccattcgtaatcagattttacctcgtcaaattttaacccgaaaagcttttgaaaatgccgtttctgtcatcatggctgtggggggatctaccaatgcagtgttacaccttttagccatagccaataccataggagttgacctcaccttagacgattttgaaaccatccgtcaacgggttcccgtcttgtgtgatttaaaaccatcgggacggtatgttaccgttaatttgcatcaagctggtggtattcctcaagtaatgaaaatgttattaaatcatggattattacatggggatgcgttgacgatttccggtcaaactatagcagaaattctagccgatgtaccggatgaaccccctgctaatcaagatgtcattcgttcctgggataaccctgtttataaagagggacatctagccattttaaaaggtaatttagcctctgaaggcgcagttgctaaaattagtggggtgaagaatcctcaaataacaggtccggcacgagtttttgagtcagaagaggaatgtctagaggcaattttagcaggaaaaattaacgcaggagatgtgattattgtccgctacgaaggtcctagaggcggtccaggaatgcgcgaaatgttagcaccaacctctgctattattggtgccggtttaggtgattctgtgggcttaattaccgatggacgtttttctgggggaacctatggtttagtcgtgggtcacgttgccccagaagcttatgttgggggaactatcggcttagtcgaagagggtgatagtattaccattgatgctaaaaaaaagctgctgcaagtgaatgtttcagaagaagaattaagccaacgtcgggctaactggaaagcccctgaacctcgttatcaaagaggggtattagggaagtatgctaagttagtttcttctagtagtttaggggcagttactgacttgaatttgttttaa

SEQ ID NO: 471 - protein, 574 aa, Opitutus terrae
MSSQPNPTTPRPHSSVVVDGHDRAPARSMLRAVGFTDEDFRKPQIAVASSPSDMTPCNVHLGELSEHARKGIVAAGGKPVYFNTITVTDGISMGTQGMRYSLVSREVIADSIETAVAAEGFDGLIAIGGCDKNMPGSMIAIARLNRPAVFIYGGTILPGFLPGDCEHQKPLDIVSVFEAVGKHAKGELDDAGLKQVESCAIPGPGSCGGMYTANTMASAIEALGMSLPNSSAQLAVGEAKRLDCERAGAAVMAMLKSGLRPRDIMTRQAFENAIMVCTALGGSTNLILHLLAIAHSAQVPLTLEDFKVIGERVPLLADLKPFGKYNMSHLVRIGGIRPMMKLLLDRGLLHGECLTVTGETIAETLKDVKPYGAYPNEQDIIRPWDQPIKKETHLRVLRGNLAPEGAIGKITGKEGLYFKGTAKVYEGEEDALQGILRGDVVKGDVVVIRNEGPVGGPGMREMLSPTSAVAGRGLIKDVALITDGRFSGGSHGFDVGHITPEAACGGPIGIVRNGDLIEVDAVKNTISLLISEPDYQARMKANKPRPPRETRGVLAKYAKLVSTASEGAVTDKYL

SEQ ID NO: 472 - DNA, 1725 bp, Opitutus terrae
atgagttcccagcctaatccaacgactccccgcccgcattcctcagtggtggtggacggccacgaccgcgcccccgcccgctcgatgcttcgagccgtcggtttcaccgacgaggactttcgcaaaccgcagatcgccgtcgcgtcgtcgcccagcgacatgacgccgtgcaacgtgcacctcggcgaactgagcgagcacgcgcgcaagggtatcgtcgccgccggcggcaagccggtctacttcaacaccatcacggtgaccgacggcatcagcatgggcacgcagggcatgcgctacagcctggtgtctcgcgaagtgatcgccgactccatcgaaaccgcggtggcggccgaaggcttcgacgggttgatcgcgatcggcggctgcgacaaaaacatgccgggctcgatgatcgccatcgcccggctcaaccgccccgcggtgttcatttacggcggcacgattctccccgggttcctgcccggcgactgcgagcaccaaaaaccgctcgacatcgtctcggtgttcgaagccgtcggcaagcacgccaagggcgaactcgacgacgccgggctgaagcaggtggaatcgtgcgcgatccccggtcccggctcctgcggcggcatgtataccgccaacaccatggccagcgccatcgaggcgctcggcatgagcctgcccaacagcagtgcgcagctcgccgtgggcgaagcgaagcggctcgattgcgagcgcgccggtgccgcggtcatggcaatgctcaagagcgggctgcggccgcgcgacatcatgacgcgccaagccttcgagaacgcgatcatggtctgcaccgcgctcggcggttcaaccaacctcattctccacctgctcgccatcgcgcacagcgcccaggtgccgctcacgctcgaggacttcaaggtcatcggtgaacgcgttccgttgctcgccgacctgaaaccgttcggcaaatacaacatgagccatctcgtccggatcggcggcatccggccgatgatgaagctgctgctcgatcgcgggctgctccacggcgagtgcctcaccgtcacgggcgagaccatcgccgaaacgctgaaggacgtgaagccctacggcgcttatccgaacgagcaggacatcatccggccgtgggaccagccgatcaaaaaggaaacgcaccttcgcgtgctccgcggcaatctcgcccccgagggcgcgatcggcaaaatcaccggcaaggaggggctttacttcaagggcaccgcgaaggtctacgagggcgaggaggacgcgctgcagggcattctccgtggcgacgtggtcaagggcgacgtggtcgtcatccgcaacgagggcccggtcggcggccccggcatgcgcgagatgctctcgcccaccagcgcggtcgccggtcgcgggctcatcaaggacgtcgcgctcatcaccgacggccggttctccggcggcagccacggtttcgacgtcggccacatcacgccggaagcggcctgcggcggtccgatcggcatcgtgcgcaacggcgatctcatcgaggtcgacgcggtgaagaacacgatcagcctgctgatttccgagccggactaccaggcccgcatgaaggccaataaaccgcggccgccccgcgagacccgcggcgtgctcgccaaatacgccaagctcgtcagcaccgcctccgagggcgccgtgacggacaagtatctttga

SEQ ID NO: 473 - protein, 558 aa, Leptospira biflexa
MSLNRYSRVLTQDESLPASQAMIIGSGVPYEDLNKPFVGIGSTGFDGNPCNMHLTTLAALQKKSVLDTKQMVGLLFNTIGVSDGITNGNDGMRYSLPSREIIADSIETISGAHFYDGIIFTAGCDKNMPGAIMAMARLNRPAIMVYGGTINGGHFKGEKLNIVSAFEAYGKKINGKISEEDFKEVIKNSCPGPGACGGMYTANTMATAIEVMGMSLPYSSSSPARSEEKKKECQEIGKYMYNLLEKDIKPSDIITPKSILNALRVITILGGSTNAALHMIAIARTMGIDLDLDQIQKVTDTTPLLADMKPSGKYLMEDLFAIGGTPAIMKFMLNEGMLDGSCLTVTGKTIAENLESLPDLPKDQDLLRPVSNPIKKEGHIQVLYGNIAKKGAVAKITGHEGEMFEGKAICFDSEVAANEGIRDGKVKPGHVVVIRYVGPKGGPGMPEMLKPTSAIIGAGLGDNVALITDGRFSGGSHGFVVGHITPEAMEGGEIALVEDGDVISINARTNTLDVKVSAEDLEKRRKKWKKPPYRVTSGYLWKYIQMVKDASTGCLTDR

SEQ ID NO: 474 - DNA, 1677 bp, Leptospira biflexa
atgagtttgaatcgatacagccgtgttttaacccaagacgaatctctccctgcatcccaagcaatgatcattggttcaggagttccttacgaagatttgaacaaaccttttgtcggaataggtagtacaggttttgacggaaatccttgtaacatgcatttgacaacccttgctgctttacaaaagaaaagtgtccttgatacaaaacaaatggttggacttttgtttaacaccatcggtgtgagcgatggaatcacgaatggaaatgatggaatgcgttattcccttccgtcacgtgagatcattgctgattcgattgaaacgatctcaggtgctcatttttatgacggaattattttcactgctggatgtgataaaaatatgccaggtgctattatggcgatggcaagactcaaccgtcccgccatcatggtgtatggcggaaccatcaatggtggccacttcaaaggagaaaaattaaatattgtttctgccttcgaagcatatggaaaaaaaattaacggaaaaatttcagaagaagatttcaaagaagtgatcaaaaactcctgcccaggtcctggtgcgtgcggtggaatgtacactgcaaatacaatggcaacagcgatcgaagtgatggggatgagtttgccatatagttcttcctcaccggcacgcagtgaagaaaaaaagaaagaatgccaagaaattggaaagtacatgtacaatcttttagaaaaagacatcaaaccttctgatatcatcactcctaaatccatcttaaatgcactccgtgtcatcacaatccttggtggatcaacgaatgcagcactccatatgatagccatcgcaaggacaatgggaattgatttagacctcgatcaaatccaaaaggtaacggatacaacaccattacttgccgacatgaaaccaagtggaaagtatttgatggaagatctttttgccattggtggaacacctgccatcatgaaatttatgttaaatgaaggtatgttagatggttcctgtttaactgtcactggaaaaaccatcgcagagaatttagaatctctaccggaccttcccaaagaccaagacttacttagacctgtcagtaacccgatcaaaaaagaaggtcatatacaagtgttatatggtaatatcgccaaaaaaggtgcagtggcaaaaatcactgggcatgaaggcgaaatgtttgaaggcaaagccatttgttttgattctgaagtcgcagcaaacgaagggattcgggatggaaaagtgaaacctggccatgttgttgtcattcgttatgtgggtccaaaagggggaccagggatgccagagatgttaaaaccaacttctgccatcattggagctggccttggtgacaatgttgctctcatcactgatggaaggttctctggtggaagccatggatttgtagtgggtcatatcactccagaagccatggaaggtggagaaattgctctcgttgaagatggggatgtaatttcgatcaatgcacgcacaaatacactcgatgtcaaagtcagcgctgaagatctggagaaacgacgtaaaaaatggaaaaaacctccttaccgagtgacaagcggttacctatggaagtacatccaaatggtaaaagatgcaagtacaggttgtttgacagaccggtaa

SEQ ID NO: 475 - protein, 578 aa, Methylacidiphilum infernorum
MNNDPSLFRLKEESSRQNKKSLHRAYSSKVFDGFIRSPNRSMLYPLGFSSTDLSQKDLIGIASTWSQVTPCNMHIDKLAREAAFGSCEAGAKALIFNTITISDGISMGTPGMKYSLVSREVIADSIETVVCCEGMDGIVALGGCDKNMPGCLIAMARLNRPAVFVYGGTILAGCYGGRQLDIVSVFEAVGSYAEGKISEEELKAIEQHAIPGPGSCGGMYTANTMACAIEALGMSLPNSSTHPAVSLDKIEDARNAGKAVLRLIDQGIRPRDILTKKAFENAITVVIALGGSTNAILHLLAIAHAAEVDLRLEDFDRIGRKVPVLADLKPSGKHSVADLSQVGGLAPLMKRLLEEGLLHGDSLTVTGETLAQNLASVADYPPSQTIVRPFSDPIKKESHLVILRGNLAPDGAVAKITGREGEKFSGVARPFDSEEEALEKILDGTIKKGDVVVIRYEGPKGGPGMREMLAPTAAIMGRGLGKDVALITDGRFSGGTHGFVVGHICPEAAVGGPLAVVEEGDTITIDAQNKEITLHVSPDVLQSRLSRWTPPPLKVKGVLYKFAKTVSQANLGAVTDLF

SEQ ID NO: 476 - DNA, 1737 bp, Methylacidiphilum infernorum
atgaacaacgatccctctctttttcgtctcaaagaagaatcaagccgacaaaataaaaaaagcctgcacagggcctattcctccaaggtattcgacggctttatccgctcccccaaccggtccatgctttatccccttggtttttcttcgaccgatctctctcaaaaagaccttatcgggatagcttcgacctggagccaggttaccccctgtaacatgcatatcgataagcttgcccgggaagccgctttcggtagctgcgaggccggggccaaggctctcatatttaacacgattacgatttcagatgggatatcgatgggcaccccggggatgaaatattccctcgtatccagggaggtcattgccgattccattgaaacggtggtttgttgcgaagggatggatgggatcgtggcccttgggggatgcgataaaaacatgcccggttgtctcatcgccatggcccggttaaataggcctgcggtatttgtttacgggggaacgatccttgccggttgttatgggggcaggcaactcgacatcgtttcggtatttgaagcggtcggatcctatgccgaaggcaagatcagcgaggaagaactcaaggcgattgaacagcatgccatccccggacccggatcctgcgggggcatgtatacggccaataccatggcttgcgccatcgaagccctcggcatgtctcttcccaacagttccacccatcccgccgtttccctcgataaaatcgaagatgcccgcaatgcaggcaaagcggtgcttcgactcatcgaccagggtattaggccaagggatattttgaccaaaaaagcctttgaaaacgccatcacggtggtcatcgccctgggaggatcgaccaacgcgatccttcatctcttagccatcgcccatgccgccgaagtggacctccggcttgaagacttcgaccgcatcggccgaaaagtccccgtgctggccgatctcaagccctcggggaagcactccgttgccgatctttcccaggttggagggttggctcctcttatgaaaaggctgttggaagagggccttttgcacggggactcgcttacggttacaggggaaacgttggcccaaaacttggcttccgttgccgattaccctccctcgcaaacgattgttcgacccttttccgatccgataaaaaaagagagtcatttggtcattctccggggcaacctcgcccccgacggagccgtggccaagataacgggaagggaaggagaaaaattcagcggtgtagcccgtccgtttgattccgaggaggaggccttggaaaagatcctcgatgggaccattaaaaagggagacgtggttgttatccgctacgaaggacccaagggggggccgggaatgcgcgagatgctcgctcccacggcagccatcatgggaagggggttaggcaaagatgtcgcgctgattaccgatgggaggttttctggaggtacacacggttttgtcgtcgggcatatttgtcccgaggccgccgttggcgggcccttggccgtcgtcgaagagggcgatacaatcaccatcgacgcccaaaacaaggaaattaccctgcatgtcagtcccgatgttcttcaaagccggctgtcccggtggacacccccgcccctcaaggtcaaaggggtgttgtacaagttcgccaagacggtaagccaagccaacctgggggcggtgaccgatcttttttga

SEQ ID NO: 477 - protein, 557 aa, Cupriavidus taiwanensis
MAFNKRSRHITQGVARSPNRSMYYALGYQKEDFDKPMVGIANGHSTITPCNAGLQRLADSAIDAIRAAGANPQVFGTPTISDGMSMGTEGMKYSLISREVIADCIETAAQGQWMDGVVVIGGCDKNMPGGMIALARTNVPGIYVYGGTIKPGHWKGKDLTIVSSFEAVGEFTAGRMSEEDFEGVERNACPSTGSCGGMYTANTMSSSFEALGMSLLYSSTMANPDQEKVDSAAESARVLVEAVKRDLKPRDIITRRSIENAVALIMATGGSTNAVLHYLAIAHAAEVEWTIDDFERIRRKVPVLCNLKPSGQYVATDLHRAGGIPQVMKILLKAGLLHGDCITITGRTLAEELEHVPDAPRADQDVILPIERALYAEGHLAILKGNLAEEGAVAKITGLKNPVITGPARVFEDEQSAMDAILADRINPGDILVLRYLGPKGGPGMPEMLAPTSAIIGKGLGESVGFITDGRFSGGTWGMVVGHVAPEAYVGGTIALVREGDSITIDAHKLLLQLNVSEQELAKRRADWKAPAPRYTRGVLAKFARLASTASKGAVTD

SEQ ID NO: 478 - DNA, 1674 bp, Cupriavidus taiwanensis
atggcattcaacaagcgctcccggcacatcacgcaaggcgtggcgcgctcccccaaccgctcgatgtactacgcgctcggctaccagaaggaggacttcgacaagccgatggtgggcatcgccaacggccattcgaccatcacgccgtgcaacgccggcctgcagcgcctggccgactcggccatcgacgcgatccgcgccgccggcgcgaacccgcaagtgttcggcaccccgaccatctccgacggcatgtcgatgggcaccgagggcatgaagtactcgctgatctcgcgcgaggtcatcgccgactgcatcgagaccgcggcccagggccagtggatggacggcgtggtggtgatcggcggctgcgacaagaacatgccgggcggcatgatcgcgctggcgcgcacgaacgtgccgggcatctatgtctacggcggcaccatcaagcccggccactggaagggcaaggacctgaccatcgtgtcgtcgttcgaggccgtgggcgagttcaccgcggggcgcatgagcgaggaagacttcgagggggtggagcggaacgcctgcccgtccaccggctcgtgcggcggcatgtacaccgccaacaccatgagctcgtcgttcgaggcgctgggcatgtcgctgctgtactcgtcgaccatggccaatccggaccaggagaaggtcgacagcgccgccgaatcggcgcgcgtgctggtcgaggccgtcaagcgcgacctcaagccgcgcgacatcatcacgcgccgttcgatcgagaacgcggtggcgctgatcatggccacgggcggctccaccaacgcggtactgcattacctggcgatcgcgcacgccgccgaagtggaatggaccatcgacgacttcgagcgcatccgccgcaaggtgccggtactctgcaacctcaagccgtcgggccagtacgtggcgaccgacctgcaccgcgccggcggcatcccgcaggtgatgaagatcctgctcaaggccggcctgctgcacggcgactgcatcaccatcaccggccgcaccctggcagaggaactcgagcacgtgcccgacgccccgcgcgccgaccaggacgtgatcctgccgatcgagcgggcgctctacgccgagggccacctggccatcctcaagggcaacctcgccgaggagggcgcggtcgccaagatcaccggcctgaagaacccggtcatcaccggcccggcacgcgtgttcgaggacgagcagagcgcgatggacgcgatcctggcggaccgcatcaaccccggcgacatcctggtgctgcgctatctcggccccaagggcggccccggcatgccggagatgctggcgccgacctcggccatcatcggcaagggcctgggagagtcggtgggctttatcaccgacggccgcttttcgggcggcacctggggcatggtggtcgggcacgtcgcaccggaggcctacgtcggcggcaccattgcgctggtgcgggaaggggattcgatcaccatcgatgcgcacaagctgctgctgcagctaaatgtatcggagcaagagctggcaaagcgccgtgccgactggaaagcaccggcgccgcgctatacgcgtggggtgctggcgaagtttgcgcggctggcatcgacagcgagcaagggcgcggtgacggactga

SEQ ID NO: 479 - protein, 591 aa, Chthoniobacter flavus
MSTPAKAPSKKAASKNGASLHRVYSKHMVDGYERAASRAMLHAVGFAREDFKKSQIGIASTWSMVTPCNMHIDQLARQAEAGSNAAGGKAVIFGTITISDGISMGTEGMKYSLVSREVIADSIETVVGCEGFDGLVAIGGCDKNMPGCLIAMARLNRPSVFVYGGTILPGCITGVLAEKRLRKDRREQFAGKNLDIVSCFEAVGSYANHNMDDRELALVEEQAIPGAGSCGGMYTANTMASAIEALGMSLPNSSAQNAVSPAKAADARAAGGAVLDLIKAGIRPRDIMTKQAFENAITVVIALGGSTNAVLHLLAMAHAAGVDLKIDDFTRIGRKVPVLADLKPSGRYLMSELVGIGGQTPLMKMLLEEGLLHGDCLTVTGKTIAANLKRVKPYPKGQDIVRGFDNPIKKDSHLVVLYGNLAPEGAVAKISGKEGLSFSGKAIVFENEQDALTAILDGRVKKGHVIVIRHEGPVGGPGMREMLSPTSAVMGKGLGKDVALITDGRFSGGSHGFVVGHITPEAALGGPLAVVKNGDAITIDAVKHQLTLDIPKSDLDARLAKWKAPKPHYTRGVLAKYAKQVSTASKGAVTD

SEQ ID NO: 480 - DNA, 1776 bp, Chthoniobacter flavus
atgagcacccctgccaaagccccgtcgaaaaaagccgcttccaagaacggcgccagcctccaccgcgtctattccaaacacatggtcgatggctatgagcgcgcggccagccgggcgatgctgcacgcggtgggcttcgctcgcgaggatttcaagaagtcgcagatcggcatcgccagcacctggtcgatggtcacgccctgcaacatgcacatcgaccagcttgcccgtcaggccgaggccggctcgaacgccgccggcggcaaggccgtcatcttcggcacgatcacgatttccgacggcatttcgatgggcaccgagggcatgaaatactcgctcgtttcgcgtgaggtcatcgccgattccatcgagaccgtggtgggttgcgaaggcttcgacggcctcgtggcgatcggtggttgcgacaagaacatgcccggctgtctcatcgccatggcgcggttgaatcgcccgagcgtatttgtctatggcggcacgattttgccgggctgcatcaccggcgtgctcgccgagaagcggctgcgcaaggaccggcgcgaacagtttgccggcaagaatctcgacatcgtgagctgcttcgaagcagtcggttcctatgccaatcacaacatggacgaccgcgaactcgcgctcgtcgaggagcaggccatccccggcgccggctcctgcggcggcatgtataccgcgaataccatggccagcgcgatcgaggcgctcggcatgtccctgccgaacagctcggcgcagaacgccgtctcgccggccaaggccgccgacgcgcgcgcggcgggtggcgcggtgctcgacctcatcaaggccggcattcgtccgcgggacatcatgaccaagcaggcctttgaaaacgccatcaccgtggtcatcgctctcggtggttcgaccaatgccgtgttgcatctcctcgccatggcccacgcggccggcgtggacctgaagatcgacgactttacccgcatcggccgcaaggtgccggtgctggccgatctcaagccgagcggccgttacctcatgagcgaactcgtcggcatcggcggccagaccccgctcatgaagatgctgctcgaggaagggttgctccacggcgattgcctcaccgtgaccggcaagaccatcgccgcgaatctcaagcgcgtgaaaccctacccgaagggtcaggacatcgtgcgtggcttcgataacccgattaaaaaggacagccatctcgtggtcctctacggcaacctcgctcccgaaggtgcggtggcgaagatcagcggcaaggaaggcctctcttttagcgggaaggcgatcgttttcgaaaacgagcaggacgccctcacggcgatcctcgatggccgcgtgaagaagggtcacgtcatcgtgatccgccacgaggggccggtgggcggccccggcatgcgcgaaatgctttcgccgaccagcgccgtgatgggcaaggggctgggcaaggacgtggcgctcatcaccgacggtcgcttcagcggcggctcgcacggtttcgtggtcggccacatcacgccggaagcagccctcggtggcccgctcgccgtggtgaaaaatggcgacgccattacgatcgatgcggtcaagcaccagctcacgctcgatatcccgaagtccgatctcgacgcccgtctcgccaaatggaaagcccccaagccgcactacacccgtggcgtgctggcgaaatacgccaagcaggtcagcaccgccagcaagggcgccgttacggattaa

SEQ ID NO: 481 - protein, 561 aa, Cyanothece sp.
MSDNYRSRIITQGSQRTPNRAMLRAVGFGDNDFTKPIVGVANGYSTITPCNMGINDLALRAEAGLKQAGAMPQIFGTITVSDGISMGTEGMKYSLVSRDVIADSIETACNGQSMDGVLAIGGCDKNMPGAMIAIARMNIPAIFVYGGTIKPGKYNGQDLTVVSAFEAVGQHSAGKIDDAQLLGIERNACPGAGSCGGMFTANTMSSAFEVMGMSLPYSSTMAAEDAEKADSTEKSAFVLVDAIRKQILPSQILTRKAFENAISVIMAVGGSTNAVLHLLAIAHTIGVELSIDDFEAIRARVPVLCDLKPSGRYVIVDLHQAGGIPQVMKMLLVHDLLHGDALTITGQTVAEVLKDVPDEPPQGQDVIRPWNNPVYKEGHLAILKGNLATEGAVAKISGVKNPKITGPARVFESEESCLEAILAGKIQAGDVIIVRYEGPKGGPGMREMLAPTSAIIGAGLGDSVGLITDGRFSGGTYGLVVGHVAPEAAVGGNIALVQEGDSITIDAKERLLQLNVAEDELIRRRANWQPPIPRYTKGVLAKYAKLVSSSSIGAVTDKDLF

SEQ ID NO: 482 - DNA, 1686 bp, Cyanothece sp.
atgtcagataattacagaagtcgcatcattacacaaggcagtcaacgtacaccaaaccgggccatgcttcgggcggtaggttttggagataatgactttactaagcccattgtgggagtggctaacggatacagcaccattaccccttgtaatatgggcatcaatgatctcgcgctgcgggccgaagccggactcaagcaagcgggagccatgccgcaaattttcggcaccattaccgtgagtgacggaatttctatgggaacagaaggaatgaaatactccctcgtctcgcgcgatgtgatcgctgactctatcgaaaccgcttgtaacggtcaaagtatggatggtgtgcttgccattggcggctgtgataaaaatatgcccggggccatgatcgccatcgctcgtatgaatatccctgctatcttcgtctatggcggtaccattaaacccggaaaatacaacggacaagatttaaccgttgtcagtgcctttgaagccgtaggacaacatagtgccggtaaaatagatgatgctcaattattaggaatagaacggaatgcttgccccggggcgggttcctgtgggggaatgtttaccgctaacaccatgtcctccgcttttgaagtaatggggatgagcttaccttattcttccactatggcagcagaagatgcagaaaaagccgacagtaccgaaaaatccgcttttgtgctggtagatgccatcagaaagcaaattttgcccagtcagattttaacccgtaaagcctttgagaatgcgatttccgtgattatggccgttgggggatcgaccaacgcggttttacatttattagcgatcgctcataccataggggtagaactgagcatcgatgactttgaagccattagagctagagttcccgtactttgtgacctcaaaccgagtggacgctatgtcatcgttgatttacatcaggcggggggcattccccaagtgatgaaaatgcttctcgtccatgacttattacacggggatgctttaaccatcaccggtcaaacggttgcagaagttttaaaagacgtacccgatgaaccccctcaaggacaagatgtcattcgtccttggaataacccagtgtataaagaaggacacctagcgatcttaaaaggaaatttagccaccgagggagcagtcgctaaaattagcggggtcaaaaatcctaaaattaccggtccggcgcgagtatttgaatccgaggaaagctgtctagaggcgattcttgcaggtaaaattcaagctggcgatgtgattattgttcgttatgaagggcccaaaggtggccccggtatgagagaaatgttagccccgacttcagccattattggggcaggattgggagattccgtaggattaattactgatgggcgtttttctgggggaacttacgggctagtcgtcggtcatgttgccccagaagcagcagtaggcggaaatattgccctcgtacaagagggagatagcattaccattgatgcgaaagagcgattattacagcttaatgtagctgaagatgaattaatccgtcgtcgcgctaactggcaaccgcccatccctcgttataccaaaggtgtattagcgaaatatgccaaattagtctcttctagtagtataggagcggttaccgacaaagatttattctaa

SEQ ID NO: 483 - protein, 579 aa, Phenylobacterium zucineum
MHRKPDGSWDKSKLPSRHVTEGPSRAPHRSYFYAMGLGSREIAQPFVGVASCWNEAAPCNTALMRQAHAASEGVKRAGGTPREFCTITVTDGIAMGHEGMRSSLVSRDLIADSVELTMRGHAYDALIGVAGCDKSLPGMMMAMLRLNVPSAFIYGGSILPGTWHGREVTVQDVFEGVGKHSAGQMSLEDLCDLEQHACPGDGACGGQYTANTMACVSEAIGLALPLSSALPAAYLDRDEYARATGEAVMALLERNLRPRDICTREAFENAAVVVAATGGSTNGGLHLPAMAHECGIEFTLRDVCEIMKRTPYLADLMPGGRYPAKKMGEAGGVPMLLRTLLDAGLIHGDCMTVTGKTIRENLEGVVWNDEQDVIRPVSNPLSPTGGVVGLWGSLAPDGAIVKVAGLSHTKHRGPARVFDGEEACFAAVEARDYKEGDVLVIRYEGPKGGPGMREMLATTAAIKGQGVENIALITDGRFSGATRGLCVGHIGPEAADGGPIALVKDGDIISIDAEAGTIELEVDPIELEHRAHLLAQEEPRRTNYGSGAIWKYVQLVGPAHLGAVTHPGHAGETHVYADI

SEQ ID NO: 484 - DNA, 1740 bp, Phenylobacterium zucineum
atgcatcgcaaaccggacggatcctgggacaagtcgaagctccccagccgccacgtgaccgaggggccctcgcgggcgccgcaccggtcgtacttctatgcgatgggcctgggcagccgcgagatcgcccagccgttcgtgggcgtagcctcgtgctggaacgaggccgcgccgtgcaacaccgccctgatgcgccaggcgcacgccgcgtccgagggcgtgaagcgcgccggcggcaccccgcgcgagttctgcaccatcaccgtcaccgacgggatcgccatgggccacgagggcatgcgctcgtccctggtcagccgggacctgatcgccgactccgtcgagctgaccatgcgcggccacgcctacgacgccctgatcggcgtcgccggctgcgacaagagcctgccgggcatgatgatggccatgctgcgcctgaacgtgccctcggccttcatctacggcggctccatcctgcccgggacctggcacgggcgagaagtgaccgtgcaggacgttttcgagggcgtcggcaagcactccgccggccagatgagcctcgaggatctgtgcgacctcgagcagcacgcctgtccgggcgacggggcctgcggcggccagtacacggccaacaccatggcctgcgtgtccgaggcgatcggcctggccctgccgctgtcctcggcgctgccggcggcctatctcgaccgcgacgaatacgcccgcgccaccggcgaggcggtgatggccctgctggagcgcaacctgcgtccgcgcgatatctgcacccgcgaggcgttcgaaaacgccgccgtggtggtggccgcgaccggggggtcgaccaacggcggcctgcacctgccggccatggcccacgagtgcggcatcgagttcaccctgcgcgacgtgtgcgagatcatgaagcggacgccgtacctggccgacctgatgccgggcgggcgctatccggccaagaagatgggcgaggcgggcggcgtgccgatgctgctgcgcaccctgctggacgccggcctgatccacggcgactgcatgacggtcaccggcaagacgatccgcgagaacctggaaggcgtcgtctggaacgacgagcaggacgtcatccgcccggtctccaatccgctgtcgcccacgggcggcgtcgtcggcctgtggggctcgctggcccccgacggcgcgatcgtgaaggtggccggcctcagccacaccaagcaccgcggcccggcccgggtgttcgacggcgaggaggcctgcttcgccgccgtcgaggcgcgcgactacaaggaaggcgacgtgctggtcatccggtacgaggggcccaagggcggccccggcatgcgcgagatgctggccaccacggcggccatcaagggccagggcgtggagaacatcgcgctcatcaccgacggccggttctcgggcgccacgcgcggcctctgcgtcggccacatcggtccggaagccgcggacggcggccccatcgcgctggtgaaggacggcgacatcatctccatcgacgccgaggccggcacgatcgagctggaggtcgatccgatcgagctggagcaccgcgcccacctgctggcccaggaggagccccgccggacgaactacggctcgggcgcgatctggaagtacgtccagctcgtgggccccgcgcacctcggcgccgtgacccatccgggccacgctggcgagacgcacgtctacgcggacatctga

SEQ ID NO: 485 - protein, 557 aa, Leptospirillum sp.
MKKPFRSRAITEGVERSPNRAMLRAVGFQDGDFEKPIIGVANGYSTITPCNMGLNSLALRAEDALRQKGAMPQIFGTITVSDGISMGTEGMKFSLVSREVIADSIETAVNAQSMDGVIAIGGCDKNMPGALIAMGRMNIPSIFVYGGTIKPGHWEGQDLTVVSSFEAVGAYSAGKMDEATLTEIERHACPGAGSCGGMFTANTMSSAIEAMGMSLPYSSTMAAEDLEKAESAAESARVLVQAVLNDLRPRQILTRKAFENAIAVLMAVGGSTNAVLHLLAIARSVDVPLSIDDFEHIRRKVPVLCNLKPSGAYVATQLHAVGGIPLVMRMLLDKGLLHGDALTITGRTISETLRNVPSRPPAGQDVVLPFDKPVYREGHLAILKGNLAPEGSVAKISGIKHRSITGPARVFDSEESCMAAILAREIRPGDIVVIRYEGPKGGPGMREMLAPTSALIGEGLGDSVGLITDGRFSGGTYGMVVGHVSPEAAVGGPIGLVQEGDLITIDADRNLIEVKVSEEEMTRRQSLWKEPPLRYTKGIMAKYRLLVKSASEGAVTD

SEQ ID NO: 486 - DNA, 1674 bp, Leptospirillum sp.
atgaaaaagccatttcgaagccgggccatcacggaaggagtggaaaggtctcccaacagggccatgctccgcgccgtcggtttccaggatggggattttgaaaaaccgatcatcggagtggcgaatggttacagcaccattaccccctgcaacatggggttgaacagtctggcgcttcgcgccgaggatgcccttcgccagaaaggagccatgccccagatctttggaaccatcacggtttcggatggaatatcgatgggaacggagggaatgaagttttccctggtgtcccgggaagtcatcgccgactccatcgaaacggcggtcaacgcccaaagcatggacggcgtgatcgccatcggggggtgcgacaagaacatgccgggagccctgatcgccatggggcgcatgaacatcccctccatctttgtttatggaggaaccatcaagcccggacactgggaaggccaggacctgacagtcgtgagctcgtttgaagccgtcggggcctactcggcaggcaagatggatgaggcgaccctgaccgaaatcgaacgtcatgcctgtccgggagccggatcctgtggcggcatgttcaccgccaataccatgtcgtcggcgatcgaagccatggggatgagtttgccctattcctctaccatggcagcggaagaccttgaaaaagcggagagcgcggcggaatccgcaagagttcttgtccaggcggtcctgaacgacctgcgtccccgacagatcctgacccggaaggcctttgaaaacgccattgcagtcctgatggccgtcggaggttcgacaaacgcggttcttcacctcctcgcgatcgcccgctccgtcgacgtccccctttccatagacgactttgaacacattcgacggaaggtccctgtcctctgcaacctcaagccctccggggcctatgtcgccacacagcttcacgctgtcgggggcattcccctcgttatgcgcatgctgctggacaaagggctcctccatggcgacgcgctgaccattacaggacggacgatttccgagaccctccggaacgtcccctcccggcccccggccggacaggatgtcgttctccccttcgacaaacccgtttaccgggagggccatcttgcgatcctgaaggggaatctcgcccccgaaggatccgtcgcaaagatctcgggcatcaaacaccgttccatcaccggcccggcccgggtattcgactccgaagaaagctgcatggcagccatcctggcccgggagattcgtcccggagacattgtcgtgatccgttacgaaggccccaaaggcggtcccggcatgcgggaaatgctggccccgacctccgccctgatcggagaaggtctcggggactcggtcggcctgattacagacgggcgcttttccgggggaacatacggcatggtggtggggcacgtctcaccggaagcggctgtgggcgggccgatcggactggtgcaggaaggagacctcattacgattgacgccgaccggaatctgatcgaggtcaaggtttcggaagaggaaatgacgagaagacaatctctgtggaaggagccccctctccggtacacaaagggaatcatggccaaataccgtcttctcgtcaaaagtgccagcgaaggcgccgtgacagactga

SEQ ID NO: 487 - protein, 560 aa, Arthrospira maxima
MSDNLRSKAITQGNQRTPNRAMLRAVGFGDEDFNKPIVGIANGYSTITPCNMGLNDLALRAEAALRQSGTMPQLFGTITISDGISMGTEGMKYSLVSRDVIADSIETVCNGQSMDGVLAIGGCDKNMPGAMIAIARMNIPAIFVYGGTIKPGHYNGCDLTVVSAFEAVGQHSAGKIPDEELLGIERNACPGAGSCGGMFTANTMSSAFEAMGMSLMYSSTMAAEDAEKAESTEQSAFVLAEAIRKQILPSQILTRDAFENGMAVIMAVGGSTNAVLHLLAIASSMGVELTLDDFETMRQRVPVLCDLKPSGRFVTTEFHQAGGVPQVMKMLLEHGLLHGDALTITGKTIAEQLTDIPAEPDPNQEVIRPWDNPMYAQGHLAILKGNLASEGSVAKITGVKNPQITGPARVFESEEECLEAILAGSINPGDVIIVRYEGPKGGPGMREMLAPTSAIIGAGLGDSVGLITDGRFSGGTYGLVVGHVAPEAAVGGAIALVKEGDSITIDAKARLLQINISDEELQARREEWQPRQPRYTRGVLAKYAKLVSTSSRGAVTDVNL

SEQ ID NO: 488 - DNA, 1683 bp, Arthrospira maxima
atgtcagataatttgagaagtaaagcaattacccagggcaatcagcgaacccctaaccgggctatgttaagggctgtaggctttggcgatgaggatttcaataaacccattgtgggcattgctaatggttatagtaccattactccctgcaatatgggcttaaatgatttagcattacgggcagaagcggccctgagacaatcgggaactatgccccaactgtttggaaccattactatcagtgatggtatctctatgggtacggaggggatgaaatattccctagtgtcgcgggatgtaattgccgattccatagaaactgtctgtaatggtcagagtatggatggggtgttagctattggcggatgtgataaaaatatgcctggggcgatgattgccattgctcgcatgaatattccggcaattttcgtttacgggggaactatcaaaccgggtcactataatggctgtgacctcactgtggttagcgcctttgaagcggtgggacaacatagcgcggggaaaatccctgatgaggaattactggggattgaacgcaatgcttgtcctggggcgggttcctgtggtggtatgtttacggctaatactatgtcgtcagcttttgaggctatggggatgagtttgatgtactcttcgactatggcggctgaagatgcggagaaagcggaaagcactgaacaatcggcgtttgtattggctgaggcgattcggaaacagattttaccgagccaaattctcacccgtgatgcttttgaaaatggtatggcggtgattatggctgtggggggttctactaatgcggtgctacatttactggcgatcgccagttctatgggggtagaactaactctggatgattttgaaactatgcgacaacgggttccggtattgtgcgacctgaaacctagtggtcggtttgtaactacagaatttcaccaagctgggggagttccccaggtgatgaaaatgttgttggaacatggcttgttacatggcgatgctttgacgattactggtaaaactattgcggaacagttgactgatatcccggctgaacctgaccctaaccaggaggtgattcgcccttgggataatcctatgtatgctcaaggacatttggctattctcaagggtaatttggcttcggaggggtctgtggctaaaattactggggtcaaaaatcctcaaattactggaccggctagggtgtttgagtcggaggaggaatgtcttgaggcaattctggcgggttcaattaatccgggagatgtgattatcgtccgctatgaaggcccgaaaggggggccgggaatgcgggagatgctggctcctacttcggcgattattggggctggtttgggggattctgtggggctgattactgatggtcgcttctcagggggaacctatggtctggttgtgggtcatgtggctccagaggcggcggtcggaggtgcgatcgccttagtgaaggagggcgatagtattactattgatgctaaagcccgcctattacaaattaatatctctgatgaggaattacaggcgcgacgggaggaatggcagcctcgtcaacctcgctatacgaggggagtcctagctaagtatgctaagttggtatccactagcagtcgcggcgcggtcacggatgtaaatttgtaa

SEQ ID NO: 489 - protein, 574 aa, Oligotropha carboxidovorans
MDAKTNIKSRLPSRHVTEGPARAPHRSYLYAMGLTTEQIHQPFVGVATCWNEAAPCNISLMRQAQAVKKGVASAGGTPREFCTITVTDGIAMGHEGMRSSLPSREVIADSVELTIRGHSYDALIGLAGCDKSLPGMMMAMCRLNVPSIFIYGGSILPGNFRGQQITVQDMFEAVGKHSVGEMSDADLDEIERVACPSAGACGAQFTANTMATVSEAIGLALPYSAGAPAPYEIRDSFCAAAGEKVMELIARNIRPRDIVTRKALENAAAVVAASGGSTNAALHLPAIAHECGIEFDLFDVAEIFKKTPYVADLKPGGRYVAKDMFEAGGIPLLMKTLLDNGYLHGDCLTVTGRTIAENLQSVKWNPHQDVVRPADRPITATGGVVGMKGNLAPEGAIVKVAGMSVLKFTGPARVFDCEEDAFEAVEKRTYKEGDVLVIRYEGPRGGPGMREMLATTAALYGQGMGAKVALITDGRFSGATRGFCIGHVGPEAAIGGPIGLLRDGDIIELDAEAGTLNVRLSEAELAERRKVWKPRETGTGSGALWKYAQQVGPAVRGAVTHPGKAGEKSCYADI

SEQ ID NO: 490 - DNA, 1725 bp, Oligotropha carboxidovorans
atggacgccaagaccaacatcaagtcgagattgccgagccgccatgtcacggaaggcccggcccgcgctccgcaccgctcctatctctacgccatgggtctcaccaccgagcagatccatcagccgttcgtcggcgtggcgacctgctggaatgaggctgctccctgcaatatttcgctgatgcgccaggcgcaggccgtgaagaagggcgtcgcctcggcgggcggcaccccccgcgagttctgcaccatcaccgtcaccgacggcatcgccatgggccacgagggcatgcgctcctcgctgccgtcccgcgaggtgatcgcggattccgtcgaactcaccatccgcggccattcctatgacgccctgatcgggctcgccggctgcgacaagtccttgcccggtatgatgatggcgatgtgtcgcctcaacgtgccctcgatcttcatctatggcggctcgatcctgcccggcaatttccgcggccagcagatcaccgtgcaggatatgttcgaggcggtcggcaagcattcggtcggcgaaatgtccgacgccgacctcgacgaaatcgagcgcgtggcgtgtccctcggcgggcgcctgcggcgcgcagttcaccgccaacaccatggcgaccgtctccgaggcgatcgggcttgcgctgccgtattcggccggcgcgccagcgccttatgaaatccgcgactccttctgcgcggcggcgggcgagaaggtgatggagctgatcgccaggaacatccgtccgcgcgacatcgtcacccgcaaggcgctggaaaatgccgcggctgtggttgcggcctccggcggctcgaccaacgcggcgctgcatctgcctgcgattgcacatgaatgcgggatcgaattcgatctgttcgacgtcgccgaaatcttcaaaaagacgccttatgtcgcagatttgaagccgggtggccgttatgtggccaaagacatgttcgaagctggtggcattccgctgctgatgaagacgctgctggacaacggttatctgcacggcgactgcctgacagtgacgggccgtaccattgccgagaacctccagagcgtgaaatggaacccgcaccaggatgtggtgcgtccggcggatcggccgatcacggcgaccggcggcgtcgtgggcatgaagggcaacctcgcgccggagggcgcgatcgtgaaggtggctggcatgtccgtcctgaagttcacgggccccgcgcgcgtgttcgactgcgaggaagacgcgttcgaggccgtggaaaaacgcacctacaaggaaggcgacgttctcgtgatccgctacgagggccccaggggcggcccgggcatgcgcgagatgctcgccaccactgctgctctttatggccagggcatgggcgcgaaggttgcgcttatcaccgacgggcgcttctccggcgccacgcgcggcttctgcatcggccatgtcggcccggaagcggcgatcggcggcccgattggccttctccgggacggagacatcatcgaacttgatgccgaagccggcacgctcaatgtcaggctgagcgaggccgaactggccgagcggcgcaaggtgtggaaaccgcgcgagacgggcactggctccggtgcgctctggaaatatgcccagcaggtcggccctgcggtcaggggagcggtgacgcaccccggcaaggcgggtgagaagagttgctatgcggatatttaa

SEQ ID NO: 491 - protein, 577 aa, Rhodospirillum centenum
MPTGPEKTWDKSKLPSRHVSVGPERAPHRSYYYAMGMTEQEIARPFVGVATCWNEAAPCNIALNRQAQAVKTGVKAEQGTPREFTTITVTDGIAMGHQGMKASLVSREVIADSVELTMRGHCYDALVGLAGCDKSLPGMMMAMVRLNVPSVFMYGGSILPGKFRGKDVTVQDVFEAVGAFSAGRMDEKDLHELECCACPGSGACGGQYTANTMACVSEAIGLALPGSAGAPAPYESRDAYAEASGRAVMKLVEMNLRPRDIVTRKALENAAVVVAASGGSTNAALHLPAIAHEAGIEFDLHDVAAVFRRTPYIADLKPGGRFVAKDLFEVGGVPVLMKALLDGGFLHGDCITVTGRTIAENLADVVFPTDQEVIRPTSAPLSPTGGVVGLRGNLAPQGAIVKVAGMKNLRFSGPARCFDREEDAFAAVERREYKEGEVIVIRYEGPRGGPGMREMLATTAALYGQGMGDKVALITDGRFSGATRGFCIGHVGPEAAVGGPIGLLRDGDVITIDATTGELSVALSDAELAERRKGWQPRRHDFQSGAIWKYAQTVGDAEKGAVTHPGGKAETHCFADI

SEQ ID NO: 492 - DNA, 1734 bp, Rhodospirillum centenum
atgcccaccggccccgagaagacctgggacaagtccaagctgccgagccggcatgtgtccgtcggtccggagcgtgcgccgcaccggtcctactactatgccatgggcatgacggagcaggagatcgcccggcccttcgtcggcgtggcgacctgctggaacgaggcggcgccctgcaacatcgcgttgaaccgtcaggcccaggcggtgaagaccggggtgaaggcggagcagggcaccccgcgcgagttcaccaccatcaccgtcaccgacggcatcgccatgggccaccagggcatgaaggcgtcgctggtcagccgcgaggtgatcgccgattcggtcgagctgaccatgcgcggccactgctacgacgcgctggtcgggcttgccggctgcgacaagagcctgccgggcatgatgatggcgatggtccggctgaacgtgcccagcgtcttcatgtatggcggttccatcctgccggggaagttccgcggcaaggacgtcaccgtacaggacgtgttcgaggcggtgggtgccttcagcgccggccggatggacgagaaggacctgcacgagctggaatgctgcgcctgtccggggtcgggcgcctgcggcggccagtacacggccaacaccatggcctgcgtctccgaggccatcgggctggccctgccgggttcggccggtgcgccggcgccgtatgagagccgcgatgcctatgccgaggcgtcgggccgggccgtgatgaagctggtggagatgaacctccgcccgcgcgacatcgtcacccgcaaggcgctggagaacgcggccgtcgtcgtcgcggccagcggcggctccaccaacgccgccctgcacctgccggccatcgcgcacgaggccggcatcgagttcgacctgcacgatgtggccgccgtgttccggcgcacgccctacatcgccgacctgaagccgggcggccgcttcgtcgccaaggacctgttcgaggtcggcggcgtgccggtgctgatgaaggcgctgctggacggcggcttcctgcacggcgactgcatcacggtgaccggccggaccattgccgagaatctggccgacgtggtcttccccacggaccaggaagtgatccggccgaccagcgcgccgctgtcacccacgggcggcgtggtcggactgcgcggcaacctcgccccgcagggcgccatcgtgaaggtcgcgggcatgaagaacctgcgcttctccggtccggcccgctgcttcgaccgcgaggaggatgccttcgccgcggtcgagcggcgcgagtacaaggagggggaggtcatcgtcatccgctatgaggggccccgcggcggccccggcatgcgggagatgctcgccaccaccgccgccctctacggccagggcatgggcgacaaggtcgccctgatcaccgacggtcggttctccggcgccacccgcggcttctgcatcggccatgtcgggccggaggcggccgtgggcggaccgatcgggctgctgcgcgacggcgacgtcatcaccatcgacgcgaccacgggcgagctgtcggtggccctctccgacgctgagctggccgagcggcgcaagggctggcagccgcgccggcacgactttcagtccggcgcgatctggaagtatgcgcagacggtgggcgacgcggagaagggggcggtgacgcatccgggcggcaaggcggagacgcactgcttcgccgacatctga

SEQ ID NO: 493 - protein, 561 aa, Cyanothece sp.
MSDNLRSRIVTQGSQRTPNRAMLRAVGFGDNDFIKPIVGVANGYSTITPCNMGLNDLALRAEAGLKSAGAMPQMFGTITISDGISMGTEGMKYSLVSREVIADSIETACNGQSMDGVIAIGGCDKNMPGAMIAIARMNIPAIFVYGGTIKPGHYQGEDLTVVSAFEAVGKYSAGKIDDNELLAIERNACPGAGSCGGMFTANTMSSAFEAMGMSLPYSSTMAAEDAEKADSTEQSAFVLVEAIRKQILPSQILTRKAFENAIAVIMAVGGSTNAVLHLLAIANTMGVELTIDDFETIRKKVPVLCDLKPSGRYVTVNLHQAGGIPQVMKMLLNHGLLHGDALTISGQTIAEVLQDIPDEPPANQDVIRPWNNPVYPEGHLAILKGNLAAEGAVAKISGVKKPKMTGPARVFESEEACLDAILAGKISAGDVVIVRYEGPKGGPGMREMLAPTSAIIGAGLGDSVGLITDGRFSGGTYGLVVGHVAPEAFVGGTIALVNEGDSVTIDAEKRLLQLNVSDEELATRRAHWTPPKPRYQRGILGKYAKLVSSSSLGAVTDVELF

SEQ ID NO: 494 - DNA, 1686 bp, Cyanothece sp.
atgtcagataaccttagaagtcgaattgttacccaaggaagtcaacgaaccccaaaccgggctatgctcagggctgtagggtttggagacaatgactttattaaaccaatcgttggtgtagctaatggatatagtaccattacgccctgtaatatgggactcaatgacctagctttgcgggccgaagcgggattaaaaagtgccggagccatgccacaaatgtttggtaccattaccattagtgatggtatctccatggggacagaaggaatgaaatattcccttgtctcacgggaagttatcgcagactccatcgaaaccgcttgtaatggtcaaagtatggatggagtcattgccattggagggtgtgataagaatatgccaggggctatgattgctatagcccgaatgaatatccctgctattttcgtctatgggggtacgattaaacccggccattaccagggtgaagatttaaccgttgtcagtgcctttgaagccgtaggaaagtatagcgcgggtaaaatagatgataacgaattattagccattgaacgcaatgcttgtccgggtgcggggtcttgtgggggaatgtttactgctaacaccatgtcatccgcgtttgaagcgatggggatgagtttaccctattcttctaccatggccgcagaagatgctgaaaaagccgatagtaccgaacaatcggcctttgttttggttgaggctatccgtaaacagattttacctagtcagattttaacccgtaaagcctttgaaaatgcgatcgcggtcattatggctgtcggagggtcaaccaatgcagtattacacctattagccattgctaataccatgggggttgagttgactatcgacgactttgaaaccattcgtaaaaaagttccagttttgtgtgatctcaaaccatcgggacgctacgttaccgttaatttacatcaagcagggggcattccccaagtgatgaaaatgctgttaaaccatggattattacacggggatgcgttaaccatttccggacaaactatcgcggaagttttgcaagatattcccgatgaacctcccgcgaatcaagatgtcattcgtccttggaataacccggtttatccagaaggacatttagccatcctcaaagggaatttagccgcagaaggtgcggtagctaaaattagtggggtcaaaaaacctaagatgaccggtccagcaagggtttttgagtcagaagaagcgtgtttagacgcaattttagccggaaaaattagcgcgggagatgtcgttattgttcgctacgaaggacccaaaggaggccccggaatgcgagaaatgttagcccccacgtctgctattattggcgcaggattaggtgattcagtgggattaattaccgatggacggttctctggaggaacctacgggttagtggttggccatgtcgctcctgaagcctttgttggcggtacaattgccttagttaacgagggagatagtgtcaccattgatgcagaaaaacggctattgcaattaaatgtttctgacgaagaattagctacccgtcgcgctcattggactccccctaaaccgcgctatcaacggggaattttagggaagtatgctaagttagtttcttcgagtagtttaggcgcagtgaccgatgtagagctattctag

SEQ ID NO: 495 - protein, 567 aa, Thermus aquaticus
MRSDRIKKGLQQAPARSMLRAVGVGDEDFGRPFVGVVNTFTDGMPCNYHLRELALDLKEGLREAGVFPFEFGAPAISDGISMGTPGMRASLVSREVIADSIELVAQGYLYDGMAVLSACDKTIPGGAMGVIRSGVPGMVLYGGTIAPGEWRGRKLTIVEVFEAVGQRAAGRITDEELLEIERRAIPGPGACGGQYTANTMAMALEVLGLSPMGYNAIPAVHPEKPRATKEAGRILAWAIEHDWKPQDFLTRRSFLNAIAAVAATGGSTNAVLHLLAMAKEVGVELSLDDFDRVSRKTPIIADLRPWGTYAAWELYEAGGTPLVFKRLLEAGLLFGEEKTLTGRTLAEEVEQAFREAEGQKVVFPVERALKPQGGLVVLRGNLAPRGAVLKLAGTERTYFEGPARVFDSEEEAMAKVLAKEIHPGDVVVIRYVGPKGAPGMPEMLSVTSAIVGEGLGPEVALLTDGRFSGGTRGLMVGHIAPEAFVGGPIALLKEGDRVRIDVENRLLEVLLPEEELARRKESWKPRPPAFRHGVFARYAALVAQADEGAVLETPHAGMGAEGPPRAF

SEQ ID NO: 496 - DNA, 1704 bp, Thermus aquaticus
atgaggtcggatcggatcaagaaaggcttacagcaggccccggcccggagcatgctccgggcggtgggcgtgggggacgaggactttgggaggcccttcgtgggggtggtcaacaccttcaccgacgggatgccctgcaactaccacctgagggagctggccctggacctgaaggaggggctcagggaggccggggtcttcccctttgagttcggggcccccgccatctccgacggcatcagcatgggcaccccggggatgcgggcgagcctcgtaagccgcgaggtcatcgccgatagcattgagctcgtcgcccagggctacctctacgacggcatggcggtcctctccgcctgcgacaagaccatccccggcggcgccatgggggtcatcaggagcggggtccccggcatggtcctctacggggggaccatcgcccccggggagtggcggggccgtaagctcaccatcgtggaggtctttgaggccgtgggccagcgggcggcgggcaggatcaccgacgaggagcttttggagattgagcgccgggccatccccggccccggggcctgcggggggcagtacacggccaacaccatggccatggccctcgaggtcctgggcctctccccaatgggctacaacgccatccccgccgtccacccggaaaagcccagggccaccaaagaggcgggaaggatcctggcctgggccatagagcacgactggaagccccaagacttcctcacccggaggagcttcctgaacgccatcgccgccgtggccgccacgggcggcagcaccaacgccgtgctgcaccttctggccatggccaaggaggtgggggtggagctcagcctggacgactttgaccgggtctcccgcaagacccccatcatcgccgacctccggccctggggtacctacgccgcctgggagctttatgaagcggggggcacgcccctggtcttcaaaaggcttctggaggcgggcctcctctttggcgaggagaagaccctcaccgggcgcaccctggcggaggaggtggaacaggccttcagggaggccgaagggcaaaaggtggtcttccccgtggagcgggccctgaagccccagggcgggctcgtggtcctccgggggaacctggccccgaggggagcggtcttgaagcttgcgggcacggagcgcacctactttgagggcccggcccgggtgtttgactccgaggaggaggccatggccaaggtcctggccaaggagatccaccccggggacgtggtggtcatccgctacgtggggcccaagggggcccctggcatgccggagatgctttcggtgaccagcgccatcgtgggcgagggcctgggccccgaggtggccctcctcaccgacgggcgcttctccgggggcacccggggcctcatggtggggcacatcgcccccgaggcctttgtgggcgggcccatcgccctcctcaaggagggggaccgggtgcgcatagacgtggaaaaccgcctcctggaggtcctcctccccgaggaggagcttgcgaggcggaaggaaagctggaagccacgcccccccgccttccgccacggcgtgttcgcccgctacgccgccctggtggcccaggccgacgagggcgcggtgctggaaacgccccacgctggcatgggggcggaaggtccacctagggccttttga

SEQ ID NO: 497 - protein, 561 aa, Cyanothece sp.
MSDNYRSRIITEGSQRTPNRAMLRAVGFGDDDFTKPIVGIANGYSTITPCNMGINDLALRAEDGLKKAGAMPQIFGTITISDGISMGTEGMKYSLVSRDVIADSIETVCNGQSMDGVIAIGGCDKNMPGAMIAMARMNIPAIFVYGGTIKPGHYNGEDLTVVSAFEAVGQYSAGKIDDAQLSGIERNACPGAGSCGGMFTANTMSSAFEVMGMSLPYSSTMAAEDAEKADSTEKSAFVLVEAIKKQILPRQILTRKAFENAISVIMAVGGSTNSVLHLLAIAHTIGVELSLDDFETIRKRVPVICDLKPSGRYVTVNLHQAGGIPQVMKMLLVHDLLHGDALTITGQTIAEVLKDVPDEPPLGQDVIRPWDNPVYQEGHLAILKGNLATEGAVAKISGVKVPKITGPARVFESEESCLEAILAKRIKPGDVIIVRYEGPKGGPGMREMLAPTSAIIGAGLGDTVGLITDGRFSGGTYGMVVGHVAPEAAVGGTIALVEEGDTITIDAHQRLLQLNVSDEELARRRAKWQPPQPRYTTGVLAKYAKLVSSSSIGAVTDKDLF

SEQ ID NO: 498 - DNA, 1686 bp, Cyanothece sp.
atgtcagataattatagaagtcgcatcattactgaagggagtcaacgcactcctaaccgggctatgcttcgcgccgttggatttggagatgatgactttactaaacccatagtgggcattgctaacggatatagcacgattaccccttgtaatatggggattaatgacctggcactaagggccgaagacggactgaaaaaagcgggagctatgccccaaatttttggcacaattaccatcagtgatgggatttctatgggaacagaagggatgaaatattctcttgtctctagggatgtaatcgccgactccatcgaaactgtctgtaatggtcaaagtatggatggagttatagcgatcgggggttgtgataaaaatatgcccggagctatgattgctatggcgagaatgaatattccggcgatttttgtttatggaggcacaattaaacccggacactacaatggagaagatttaactgttgtgagtgcttttgaagctgtcggacaatatagcgcgggtaaaatagacgatgcccagttatcaggaattgaacgcaatgcctgtccgggggcgggttcttgtgggggtatgtttaccgctaataccatgtcttctgcgtttgaagtgatggggatgagtcttccctattcctctacaatggcggcagaagatgcagaaaaagccgatagtaccgaaaaatccgcttttgttttagtggaggcgattaaaaaacaaattctcccccgtcagattttaactcgcaaagcttttgagaatgctatctcggtgattatggcggttggcggttcgaccaattcggttttacatttattggcgatcgctcataccataggggtagaactgagtttagatgactttgaaaccattagaaagcgagtgccggtcatttgtgacctgaaaccctctggacgctacgttacggttaatttacatcaagctggtggtattcctcaagtgatgaaaatgctgttagtccatgacttattacatggggatgctttaactattaccggacaaaccattgcagaagttttaaaagatgtccccgatgaaccccctctaggtcaagatgtgattcgtccttgggataaccccgtttaccaagaaggacacctagctattttaaaaggaaacttagctacagagggagcagtagctaaaattagtggggtcaaagttcctaaaattactggacctgcccgggtctttgaatcagaagaaagttgtttagaagccattcttgccaagagaattaagccgggagatgtgattatcgtccgttatgaagggccaaaaggaggccccggaatgcgggaaatgttagcgcctacctctgctattattggggcaggattaggggatacagtgggattaattaccgatgggcgtttttctggaggaacttacggcatggtcgttggtcatgttgctcctgaagccgcagtaggcggtactattgccctcgtagaagaaggcgatacgatcaccattgatgctcatcaacgcttattacagcttaatgtgtctgatgaagaattagcccgtcgtcgtgctaagtggcaaccccctcaacctcggtatacaacaggggtattggctaagtatgctaaattagtctcttcgagtagtatcggggcagtgacggataaagatttattttaa

SEQ ID NO: 499 - protein, 557 aa, Acidithiobacillus ferrooxidans
MSDNRRSKTITQGVQRSPNRALLRAVGFGDWDFDKPIVGVANAHSSITPCNIGIGVLAARAEAALKSAGAMPQTFGTITISDGISMGTAGMKYSLVSREVIADSIETVCQGQSMDGVLALGGCDKNMPGAMIAIARMNIPAIFVYGGTIKPGHYRGQDLTIMSAFEAVGQHTVHKIDDEELLEIERRACPGAGSCGGMYTANTMSSIFEAMGMSLPYSSTMAAEDAEKAESAAQSAEVLVSAIRKQILPRQILTRQAFENAIAVAMAVGGSTNAVLHLLAIAHAAQVPLTLDDFEAMRERVPVLCDLKPSGRYVSTDLHRAGGIPQVMKILLAHGVLHGDALTISGQTLAEVLQDVPSEARTDQEVIRPWNNPIYAQGHLAILKGNLAPEGAVAKTTGFMAHKITGPARVFESEESCMEAILAQKIKPGDVVVIRYEGPKGGPGMREMLSPTSAIIGEGLGDSVGLITDGRFSGATYGMVVGHVAPEAAVGGTIALVIEGDSVTIDAGQRLLQLNVSDEEIGRRRAVWQAPAPRHTRGVLAKYAKLVSSASKGAVTD

SEQ ID NO: 500 - DNA, 1674 bp, Acidithiobacillus ferrooxidans
atgtctgacaaccgcagaagcaagaccatcacgcagggcgtgcagcgctcgcccaaccgggccctgctgcgtgcggtggggtttggtgattgggacttcgacaagcctatcgtcggcgtggcgaacgcgcacagcagcatcacgccttgcaatatcggtatcggcgtgcttgccgcccgtgcggaagcggcgctcaaatcggctggtgccatgccgcaaacgtttggcaccatcaccatttccgatggtatttcgatgggtaccgccggcatgaaatattcgctggtgtcacgcgaagtgattgccgactccattgaaacggtgtgtcagggccagagcatggacggcgtgctcgccctcggcggctgcgataagaacatgccgggcgcaatgatcgccatcgcccgcatgaacattccggccattttcgtttatggcggcaccatcaagccgggccactaccggggccaagatctgaccatcatgagcgcctttgaggcggtggggcaacacaccgtccataaaattgacgacgaagaactgctggaaatcgagcgtcgcgcctgccctggcgcgggctcctgcggcggcatgtataccgccaacaccatgtcttccatcttcgaagccatgggcatgagcttgccgtactcctccaccatggcggcggaggatgcagaaaaggcggagagtgcggcacagtccgcagaggtattggtaagcgccatccgaaaacaaatcctgccgcgccagatattgacgcggcaggcgtttgaaaacgccattgcggtggccatggccgtgggcggctccaccaacgcggtattacacctgttggccattgcgcatgcggcacaggtaccactcacccttgatgatttcgaggccatgcgcgagcgtgtgccggtactctgcgacctgaaaccatcgggccgttacgtctctaccgatctgcatcgggcgggcggcattccccaggtgatgaaaatattgctcgcccacggcgtgttacacggcgatgcgctgaccatcagcggtcagacgcttgcggaagttttacaggatgtgccgagcgaagcgcgtacggatcaggaggtgatacgtccgtggaataatcccatttatgcccaagggcaccttgccatcctgaagggcaatcttgcgcccgagggcgcggtggcgaaaaccaccggcttcatggcgcacaaaatcaccggtccggcacgggtttttgaatccgaggagtcgtgcatggaagcgatcctggcgcagaaaatcaagcccggcgatgtcgtggtcatccgctacgaagggcccaagggcggacccggtatgcgcgaaatgttatcccccacctcggcgatcatcggcgaaggattgggcgattcggttggccttattactgacggccgcttttccggcgccacatacggcatggtagtcggtcatgtcgcgccggaagccgcagtggggggcacgatcgcactagtcatcgagggagactcggtgactatagacgccggacagcgtttgctgcaactcaacgtgtctgatgaagaaatcggacgccgccgcgccgtctggcaagcacccgcaccgcgccacacgcgcggcgttttggcgaagtacgccaaattggtttcctcggccagtaagggggccgtaacagattga

SEQ ID NO: 501 - protein, 567 aa, Cyanothece sp.
MSVSSNQPINLRSQVVTQGVQRSPNRAMLRAVGFQDDDFAKPIVGVASAHSTITPCNMGIAPLAVRAEAGIRAAGGMPQVFGTITVSDGISMGTEGMKYSLVSRDVIADSIETACNAQSMDGVLAIGGCDKNMPGAMIAMARMNIPAIFVYGGTIKPGHLEGEDLTVVSAFEAVGQYSAGRIDEVRLMSVERNACPGAGSCGGMYTANTMSSAFEAMGMSLMYSSTMSAVDPEKTENTELAGKVLVEAIRNNLRPRDIITRKSIENAISVIMAVGGSTNAVLHFLAIAHSAGVPLTLDDFEAIRERVPVLCDLKPSGRYVATDLHHAGGIPQVMKMLLNQGLLHGDCVTITGETIAERLRDVPDQPAADQDVIRPWSNPMYSSGHLAILKGNLATEGAVAKISGVKQPQITGPARVFDSEEDCLAAILAGKIKAGDVIVIRYEGPKGGPGMREMLAPTSAIIGAGLGDAVGLITDGRFSGGTYGMVVGHVAPEAFVGGTIALVQEGDSITIDAHQRLLQLNVTEAELIERRVAWSPPPPCYNRGVLAKYAKLVSSSSLGAVTDLNLL

SEQ ID NO: 502 - DNA, 1704 bp, Cyanothece sp.
atgtccgtcagttcaaatcagccgatcaatttaagaagccaggttgttacccagggcgtacagcgatcgcctaatcgggccatgctacgggccgtggggttccaggatgacgattttgccaaaccgatcgtgggggtggccagtgcccacagtacaattaccccctgcaacatgggcattgctcccctggctgtgcgggcagaagcgggaattcgagcagcgggcgggatgccccaggtgtttggcaccattaccgtcagtgatggtatttcgatgggaacggagggaatgaaatactctttggtttcccgcgatgttattgctgattcgatcgaaactgcctgtaatgctcagagtatggacggtgttctagccatcggtggttgtgacaagaatatgccgggagccatgattgcgatggcccggatgaatattccggcaatttttgtctacggtggcaccattaaaccggggcatctggaaggggaagacctcaccgtggtcagtgcctttgaagcggtggggcagtacagtgctggcagaattgacgaagtgcgcctgatgtcggtggaacgcaatgcctgtccgggggcggggtcttgcggcggtatgtacacagccaacactatgtcttcggcttttgaagcaatgggcatgagcctgatgtactcctccaccatgtcagcggtagacccggaaaaaactgaaaacaccgaactggcgggtaaagtgctggtggaggcgattcgtaataatctgcgtccgcgagatatcatcacccgtaaatcgatcgaaaacgcaatttccgtgattatggcggtcggtggctccaccaatgcggtgctgcattttctcgccattgcccattcggctggggttcccctcaccctggatgactttgaagccattcgcgaacgggttccggttctctgtgatctgaagccctctggccgttacgttgctactgatttacatcatgcgggtggcattccccaggtaatgaaaatgctgctgaatcagggcttactccacggcgattgtgtcacgattacgggggaaaccattgccgagcgcctgcgggatgtgcccgatcaaccggcagcggatcaggatgtgattcgcccctggtctaaccccatgtatagcagtggtcacctggccattttgaaggggaatttggcgaccgaaggggccgtggccaagattagtggtgttaaacaacctcagattactggaccagcgcgggtgtttgactctgaagaggactgcctggcagcgattctggcgggaaagatcaaggctggcgatgtgattgtgatccgctatgaaggacccaagggtggaccggggatgcgggaaatgctggctccgacctctgccattattggggctggtctgggagatgcggtgggtttgattacagatggcagattttcaggcggtacctacgggatggtggttggccacgtcgctcccgaagcgtttgtgggaggcacgatcgccctggtgcaggaaggggattcgattacgatcgatgcccatcagcgcctgttacaactgaacgtgactgaggcagaactaattgaacgccgtgtcgcctggagtccgccgccgccctgctataaccgtggtgtgctggccaaatacgccaaactggtctcctccagcagtttgggagctgttacagacttaaatctattgtaa

SEQ ID NO: 503 - protein, 572 aa, Arthrobacter chlorophenolicus
MSESQIETESKPDIKPRSRVVTDGIHAAPARGMFRAVGMGDDDFAKPQVGVASSWNEITPCNLSLNRLAQGAKEGVHAGGGFPMQFGTISVSDGISMGHEGMHFSLVSREVIADSVETVMQAERIDGSVLLAGCDKSLPGMLMAAARLNLSSVFLYAGSIMPGWVKLEDGSEKEVTLIDAFEAVGACAAGKMSMEDLTRIEKAICPGEGACGGMYTANTMACIGEALGMSLPGSAAPPSADRRRDDFARKSGEAVVNLLRKGITARDIMTKEAFENAIAVTMAFGGSTNAVLHLLAIAREAEVELTLDDFNRIGDRIPHLGDLKPFGRYVMTDVDKIGGVPVIMKALLDAGLLHGDCLTVTGKTVAENLEAINPPDVDGKILRAMDNPIHKTGGITILHGTMAPEGAVVKTAGFDADVFEGTARVFDREQGALQALDQGEIHAGDVVVIRYEGPKGGPGMREMLAITGAIKGAGLGKDVLLLTDGRFSGGTTGLCIGHVAPEAVDGGPIAFVRDGDRIRVDIAARSFDLLVDDAELEARKVGWEPLPARYTKGVLAKYAKLVHSASTGAYCG

SEQ ID NO: 504 - DNA, 1719 bp, Arthrobacter chlorophenolicus
atgagtgagagccagatcgaaacagagagcaagcctgacatcaagccccgcagccgggtggttaccgacggaatccacgccgcaccggcgcgcggcatgttccgtgcggtcggcatgggcgacgacgacttcgcgaagccccaggtcggggttgcgagttcgtggaacgagatcactccctgcaacctctccctgaaccggctggcccagggcgccaaggagggtgtccacgccggtggcggcttccccatgcagttcggcaccatctccgtgtccgacggtatttccatgggccacgagggcatgcacttctccctggtctcccgcgaagtgatcgccgattccgtcgaaaccgtcatgcaggccgagcggattgacggttcggtcttgctcgccggctgcgacaagtcccttcccggcatgctcatggccgcggcccggctcaacctgtccagcgtgttcctctacgccggctcgatcatgccgggctgggtaaagctcgaggacggctccgagaaggaagtcaccctcatcgatgcctttgaggccgtgggcgcctgcgccgccggcaagatgagcatggaagacctcacgcgcattgaaaaggccatctgtcccggcgaaggcgcctgcggcggcatgtacacggccaacaccatggcctgcatcggtgaggcgctgggcatgtccctgcccggatctgccgccccgccctcggcagaccgccgtcgtgatgactttgcgcgcaagtccggtgaagcagtggtgaacctgctgcgcaagggcatcaccgcccgcgacatcatgaccaaggaggcctttgaaaacgccatcgccgtcaccatggcgttcggcgggtccaccaacgcggtcctgcacctgctggccattgcccgcgaagccgaggtagagcttaccctcgacgacttcaaccgcatcggtgacaggatcccgcacctcggcgacctcaagccgttcggccgctacgtcatgaccgacgtcgacaaaatcggcggcgtgcccgtcatcatgaaggcactgctcgacgccgggctgctgcacggcgactgcctcaccgtcaccggcaagaccgtggcggaaaacctggaagccatcaacccgccggatgttgacggcaagatcctgcgcgcaatggacaaccccatccacaagaccggcggcatcaccatcctgcacggcaccatggcgccggaaggcgccgtagtgaagactgcaggattcgacgccgacgtcttcgaggggaccgcccgcgtgttcgaccgcgagcagggcgccctgcaggcgctggaccagggcgaaatccatgccggcgacgtcgtggtcatccgctacgaggggcccaagggcggcccgggcatgcgggagatgctggccatcaccggcgccatcaagggcgcgggcctcggcaaggacgtcctgctgctgaccgatggccggttctccggcgggaccaccgggctgtgcatcggccacgtcgcgccggaagcggtggacggcggccctatcgccttcgtcagggacggtgaccggatccgcgtggacatcgccgcgcgcagcttcgacctgctggtcgatgacgccgagcttgaggcccgcaaggttggctgggagccgctgccggcccgctacaccaagggcgtcctggccaagtacgccaagctcgtgcacagcgcgagcaccggcgcatactgcggctga

SEQ ID NO: 505 - protein, 557 aa, Burkholderia multivorans
MSYNRRSKHITQGVARSPNRSMYYALGYQKEDFDKPMMGIANGHSTITPCNAGLQRLSDAAVEAIKAAGANPQIFGTPTISDGMSMGTEGMKYSLVSREVIADCIETCVQGQWMDGVVVVGGCDKNMPGGMIALARLNVPGIYVYGGTIRPGHWKGKDLTIVSAFEAVGEFTAGRMSDEDFEGIERNACPTSGSCGGMYTANTMSSSFEALGMSLMYSSTMANPDQEKVDSAAESARVLVEAVKRDLKPRDIITKQSIENAVSLIMATGGSTNAVLHYLAIAHAAEVDWTIDDFERIRKRVPVICDLKPSGRYVATDLHRAGGIPQVLKILLDAGLLHGDCVTITGRTLAEELKDVPSVPRTDQQVIFPIERALYKEGHLAILKGNLAEDGAVAKITGLKNPVITGPARVFDDEQSAMDAILGDKIRAGDVLVLRYLGPQGGPGMPEMLAPTSAIIGKGLGESVGFITDGRFSGGTWGMVVGHVAPEAFVGGTIALVQEGDSITIDAHKLLLQLNVDDAELARRRAAWKQPAPRYTSGVLAKYAALARPANRGAVTG

SEQ ID NO: 506 - DNA, 1674 bp, Burkholderia multivorans
atgtcgtacaaccgtcgctcgaagcacatcacgcaaggcgtcgcccgctcgccgaaccgttcgatgtattacgccctcggctatcaaaaggaagatttcgacaagccgatgatgggcatcgccaacgggcattcgacgatcacgccgtgcaacgcagggctgcagcgcctgtccgacgcggccgtcgaggcgatcaaggcggccggcgcgaatccgcagatcttcggcacgcccacgatctcggacggcatgtcgatgggcaccgaagggatgaagtactcgctcgtgtcgcgcgaggtgatcgccgactgcatcgagacctgcgtgcagggccaatggatggacggcgtcgtggtggtcggcggctgcgacaagaacatgccgggcgggatgatcgcgctcgcgcggctgaacgtgccgggcatctatgtgtacggcgggacgatccgcccgggccactggaaaggcaaggatctgacgatcgtctcggcgttcgaggcggtcggcgaattcacggccgggcgcatgtcggacgaggatttcgaaggcatcgagcgcaacgcgtgcccgacgtcgggctcgtgcggcggcatgtacaccgcgaacacgatgagctcgtcgttcgaggcgctcggcatgtcgctgatgtattcgtcgacgatggcgaaccccgatcaggaaaaggtcgattcggccgccgaatcggcgcgtgtgctcgtcgaagcggtgaagcgcgacctgaagccgcgcgacatcatcacgaagcagtcgatcgagaacgcggtgtcgctgatcatggcgaccggcggctcgaccaatgcggtgctgcactatctcgcgatcgcgcatgcggccgaggtcgactggacgatcgacgacttcgagcggatccgcaagcgtgtgccggtgatctgcgacctgaagccgtcgggccggtacgtcgcgaccgacctgcaccgtgcgggcggcattccgcaggtgctgaagatcctgctcgatgcgggcctgctccacggcgactgcgtcacgatcacgggccgcacgctcgccgaagagctgaaggacgtgccgtccgtgccgcgcaccgaccagcaggtgatcttcccgatcgagcgcgcgctatacaaggaaggccatctcgcgatcctgaagggcaatctcgccgaggacggcgcggtcgcgaagatcaccgggctgaagaacccggtgatcacgggcccggcgcgcgtgttcgacgacgagcaaagcgcgatggacgcgatcctaggcgacaagatccgcgccggcgacgtgctcgtgctgcgctatctcggcccgcaaggcggccccggcatgcccgaaatgctcgcgccgacgtcggcgatcatcggcaaggggctcggcgaatcggtcggcttcatcaccgatggccgcttctccggcggtacgtgggggatggtcgtcggccacgtcgcgcccgaggccttcgtcggcggcacgatcgcgctcgtgcaggaaggcgactcgatcacgatcgacgcgcataagctgctgctgcagctgaacgtcgacgatgcggagctcgcgcgccgccgcgccgcatggaagcagccggcgccgcgctatacgagcggcgtgctcgccaagtatgccgcgctcgcacggccggcgaatcggggcgcggtcacggggtga

SEQ ID NO: 507 - protein, 556 aa, Thermomicrobium roseum
MRSERITHGIDRAPARAMLRAVGFRDEDFDKPIVAIANTWTDAMPCNYHLRELAQHLREGIREAGGVPVEFNTIAVNDAISMGTEAMKASLISREVIADSIELMAYGYQFDALVAIVSCDKTIPGGAMGVIRAGVPAMVLYGGSIAPGHWRDRELTIVEVFEAVGAYAAGKITLEELQEIERRAIPGPGACGGQYTANTMAMALEVMGLSPMGYNAIPAIAPEKASATREAGRRFMEVVRANRTPRDFLTKTSLRNAIAAVAATGGSTNAVLHLLAIAHELGIPLSIDEFDEISQRTPIIADLKPWGKYVAWSLYKAGGTKLVVKRLLEAGLVDGDARLVTGETLAEAVADAQEAPGQPVVYHPSAPLKPHGGLVILRGSLAPEGAVLKVAGTEQMYFRGTARVFDAEEQAMQAVLNQQIKPGDVVVIRYEGPKGGPGMREMLGITAAIVGEGLGPHVALVTDGRFSGGTKGLMIGHVAPEAPVGGPIAFVQDGDTIVIDVEKRRIDLEVSETELAERRSRWSPPAPRFTNGVFARYAALVSSASQGAVLRTPAWQ

SEQ ID NO: 508 - DNA, 1671 bp, Thermomicrobium roseum
atgcgcagtgagcggatcacgcacgggatcgatcgagcaccggcccgcgccatgctgcgagcagtcggttttcgcgacgaggacttcgacaaaccgatcgtcgcgatcgccaatacgtggaccgatgcgatgccgtgtaattaccacctgcgggaactcgcccagcacttgcgcgagggtatccgcgaggctggcggtgtaccagtcgagttcaacacgatcgcggtgaacgatgccatctcgatgggaaccgaagcgatgaaggcctcgctgatcagtcgcgaggtgatcgctgactcgatcgaactcatggcgtatgggtaccagttcgatgccctggtcgctatcgtctcctgtgacaagacgattccaggaggggcgatgggggtgattcgtgctggggttcctgccatggtgttgtacggaggctcgatcgctcccgggcactggcgtgatcgcgaactcacgatcgtggaggtctttgaagcggtaggggcttacgcggccggaaagatcacgctggaggagctgcaggagatcgagcgacgcgcgatcccgggaccgggagcctgtggtgggcaatatacggcgaacacgatggcgatggcactcgaagtgatgggcttgtcgccgatgggctacaacgcgataccagcgatcgcgccggagaaggcttcagcaacccgcgaggctggccgtcgcttcatggaggtcgtccgggcgaaccgaacgccgcgcgatttcttgaccaagacctcgctgcgtaacgcgatcgctgcagtggctgcaacgggcgggtcgaccaacgcggttttgcacctcctggcgatcgcgcacgagttgggtattccgctgagcatcgacgagttcgatgagatcagccagcgaacgccgatcatcgctgatctcaaaccgtggggtaaatacgtggcatggagcctctataaggctggcgggaccaagctcgtggtgaagcgactcctcgaggctggactcgtcgatggggatgctcgtttggtgacgggtgagaccctggccgaggcagtcgctgatgctcaggaggctcctggtcagccggtcgtctatcatccgtccgctccgttgaaaccgcatggtggtctggttatcctgcgtggatcgctcgctcccgagggtgctgttctgaaagtcgccggcacagagcagatgtacttccgcggaacggctcgcgtcttcgacgccgaagagcaagcgatgcaagcggtcctcaaccagcagatcaagccaggcgatgtggtggtcattcggtacgaggggcccaagggtggtccgggcatgcgggaaatgctggggatcacggcagcgatcgtgggtgaggggctcggtccgcatgtcgcgctggtcaccgatggccggttctcaggcggtaccaagggactcatgatcggccatgtagcacccgaagcgccggtgggtggaccgatcgccttcgtccaggatggtgacaccatcgtgatcgacgtggagaagcggcggatcgatctcgaggtgtcagagacggaactcgccgaacggcgttcgcgctggtcgccgccagcaccacggttcacgaatggggtcttcgcgcgctacgctgcgctcgttagctctgcctcgcagggtgctgtcttgcggacacctgcctggcaatga

SEQ ID NO: 509 - protein, 577 aa, bacterium Ellin514
MKNNSKASKSPKADNLRPYSSLVLDGPERAPSRAMLYPVGFKPEDFKKPLIGIASTWSMVTPCNMHIDKLALEAEKGANAAGGKAIIFNTITISDGISMGSEGMKYSLVSREVIADSIETVVGCEGMDGYVAIGGCDKNMPGALMAIARMNRPAVFAYGGTILPGCITGDTRKLDVVSVFEAVGAHANKKISDGELQAIESCAIPGPGSCGGMYTANTMASAIEALGMSLPNSSAQAAISPAKKDDCQRAGAAVVNLIKKGIRPLDIMTKKAFENAITVVIALGGSTNAVLHLLAMANAAKVKLSLDDFTRIGKKVPVLADLKPSGKHLMSELVAIGGIRPLMKTLLDAGLLHGDCLTVSAQTLAEDLKGVRPYPVGQTIIRPLNDPIKKDSHLVVLYGNLSPEGSVAKITGKEGLRFEGRARVFNSEELALKKILDGGIKKGDVVVIRYEGPKGGPGMREMLSPTSAIMGKGLGKEVALITDGRFSGGTHGFVVGHITPEAHVGGPLALVKEGDTIVIDAEKRELSVNISAKEMAARRKTWKQPKARYTRGVLAKYAHLVTSASLGAVTDNNLNLE

SEQ ID NO: 510 - protein, 1734 aa, bacterium Ellin514
ATGAAAAACAATTCGAAAGCCAGCAAGTCGCCTAAAGCCGACAATTTGCGCCCCTATTCCAGCCTCGTCCTCGACGGCCCTGAACGCGCACCCAGCCGCGCCATGCTTTATCCCGTCGGTTTCAAACCCGAAGATTTCAAGAAGCCCCTCATCGGCATCGCCTCCACGTGGAGCATGGTTACCCCGTGTAACATGCACATCGATAAACTCGCGCTCGAAGCCGAGAAAGGCGCCAACGCCGCCGGCGGCAAGGCCATTATTTTCAATACCATCACCATCTCCGACGGCATCTCCATGGGTTCCGAAGGTATGAAATATTCCCTCGTCTCCCGCGAAGTCATCGCCGACTCCATCGAAACCGTCGTTGGTTGCGAAGGCATGGACGGCTATGTCGCCATTGGTGGTTGCGATAAAAATATGCCCGGCGCCCTGATGGCCATCGCCCGCATGAACCGTCCCGCCGTCTTCGCTTATGGCGGAACAATCCTCCCCGGCTGCATCACTGGCGACACGCGCAAGCTCGACGTCGTCTCCGTCTTCGAAGCCGTCGGTGCTCATGCCAACAAGAAAATCAGCGACGGCGAACTGCAAGCCATCGAGTCCTGCGCCATCCCTGGCCCCGGCTCATGCGGCGGCATGTATACTGCCAACACCATGGCCAGCGCGATCGAAGCACTCGGCATGAGCCTGCCGAACAGCTCAGCTCAAGCCGCGATCTCTCCGGCCAAGAAGGATGATTGCCAGCGCGCCGGTGCCGCCGTGGTTAACCTGATCAAGAAAGGCATCAGGCCGCTCGACATCATGACCAAAAAGGCGTTCGAAAATGCCATCACGGTCGTCATCGCTCTCGGTGGCTCGACCAATGCCGTTCTCCACCTGCTCGCCATGGCCAATGCCGCCAAGGTAAAACTCTCGCTCGATGATTTCACCCGCATCGGCAAAAAGGTTCCTGTCCTCGCCGATCTCAAACCCAGCGGCAAACATCTCATGTCGGAACTCGTCGCCATCGGCGGCATACGTCCTTTGATGAAAACCTTGCTCGACGCCGGCTTGCTTCATGGCGATTGCCTCACCGTCAGCGCCCAGACTCTCGCGGAAGACCTCAAAGGCGTGCGCCCCTACCCCGTTGGTCAGACAATTATCCGTCCACTCAACGATCCCATCAAGAAGGACAGCCATCTCGTCGTCCTCTATGGCAATCTTTCTCCCGAGGGTTCCGTTGCCAAGATTACCGGCAAGGAAGGTCTCCGCTTTGAAGGCCGCGCCCGCGTCTTCAACTCCGAAGAACTCGCCCTCAAAAAGATTCTCGATGGCGGCATCAAGAAAGGTGATGTCGTGGTCATACGCTACGAAGGCCCCAAGGGTGGCCCCGGCATGCGTGAAATGCTCAGCCCCACTTCCGCCATCATGGGCAAAGGCCTCGGCAAGGAAGTCGCCCTTATCACCGACGGTCGCTTCTCCGGCGGCACCCATGGTTTCGTGGTCGGCCACATCACCCCGGAAGCCCACGTTGGCGGTCCTCTCGCACTGGTGAAGGAAGGCGACACCATCGTCATCGATGCAGAAAAACGTGAACTCTCCGTAAACATTTCCGCGAAGGAAATGGCTGCCCGTCGCAAAACTTGGAAGCAGCCCAAGGCCCGTTACACCCGTGGCGTACTCGCCAAATATGCCCACCTCGTCACCTCCGCATCATTAGGCGCCGTGACCGACAATAATTTAAACCTCGAATAA

SEQ ID NO: 511 - protein, 559 aa, Desulfobacterium autotrophicum HRM2
MAEKLNLYSSRITGPKSQGASQAMLYGAGLTDADMEKAQVGISSVWYEGNPCNMHLNDLAALVKEGVVNSGLVGLRFNTIGVSDGISMGTSGMSYSLQSRDLIADSIETVMQAQWYDANISLPGCDKNMPGCLIAMARVDRPALMIYGGTIRAGCLDGNKLDVVSAFQSYGEYLAGKINDDQRRAIVKNSCPGAGACGGMYTANTMASAIEAMGMSLPYSASSPANSQAKQKECLQAGAAIRTLLEKNIKPSHIMTPKAFENAMVVITALGGSTNAVLHMIAIARSINVPLTIDDFQRISDRVPLLADMKPSGQYLQEDLNNVGGIPGVMKRLLHAGLLHGDCLTVTGKTLAENLKDLPPLQSGQQVIRPLTHPVHPRGHIQILKGSLAPEGAVAKLTGKEGLRFTGPANVFDSEEDMLLALENGKIHKGDVIIIRFEGPKGGPGMPEMLTPTSAIMGAGLGKDVALLTDGRFSGGSHGFIVGHITPEAQEGGPIALVQNGDPITIDADTNIIDVDILESELKRRQRSWQAPPLKAVRGTLFKYIKNVSSASKGCVTDE

SEQ ID NO: 512 - DNA, 1680 bp, Desulfobacterium autotrophicum HRM2
atggcagaaaaactaaatttatacagctcccgcatcacaggtcccaagtcccagggagcatcccaggccatgttgtacggtgccggactgaccgatgcggatatggagaaggctcaggtggggatcagcagtgtctggtacgagggcaacccctgcaatatgcatctcaacgatctggctgcccttgtgaaagaaggcgtggtaaattcaggccttgtggggctcagatttaataccatcggggtgagtgacgggatctccatggggacttccggtatgagctattcgctccagtccagggatttaattgccgattccattgaaaccgtcatgcaggcacaatggtatgatgccaacatttctttacccggatgcgacaaaaacatgcccggctgcctgatcgctatggcaagggttgaccgcccggccctgatgatatacggcggcaccatacgagccggatgtctggacggaaataagctggatgtcgtctctgctttccagagttatggtgaatacctggccggaaaaatcaatgatgaccagcgtcgggccattgttaagaacagttgcccgggagcaggcgcatgcggcggtatgtacactgccaataccatggcctcggccatagaagccatggggatgtccctgccttacagtgccagcagcccggcaaattcccaggccaaacagaaggaatgccttcaggcgggggcggccattagaacccttttggaaaaaaatataaaacccagccatattatgacaccaaaggcatttgaaaatgccatggtggttattacggccctgggcggctccaccaatgcagtgctgcatatgattgccattgcccgttccatcaatgtccccctgaccattgatgattttcaaagaatcagtgaccgtgttcctttgctggcagatatgaaacccagcggtcagtaccttcaggaagatctgaataatgtgggcgggataccaggggtaatgaaacgattactccatgcgggtttactgcatggcgactgcctgaccgtaaccggaaagactttggctgaaaatttgaaagatctgccgccacttcaaagcgggcagcaggtcatccgtccgcttacccatccggttcaccccaggggccatattcagatcctgaaaggaagcctggcccctgaaggcgctgtggccaaactcacaggcaaggaagggctgcgtttcaccgggccggcaaatgtttttgattctgaagaggatatgctcttagctctggaaaacggaaaaatccataaaggtgatgtcatcatcatccgctttgaaggccccaaaggcggacccggcatgcctgaaatgctgacacccacctcagccattatgggggcaggtcttggtaaagatgtggccctgttaactgacggcaggttttcagggggatcccacggttttattgtgggacatatcacccctgaagcccaggagggcggccccatcgcactggttcaaaatggtgacccaattaccattgatgctgacaccaatataatcgacgtcgatatcttggaatctgaattgaagcggcgtcaaaggtcctggcaggctccgccccttaaggctgtccggggaaccttatttaagtacattaagaatgtatcctcagcatcaaaggggtgtgtaacggatgagtag

SEQ ID NO: 513 - protein, 561 aa, Thioalkalivibrio sp.
MTQDNRRSRVVTEGPRRTPNRAMLRAVGFGDDDFQRPIVGIANAHSTITPCNMGIGALAERAESAVRASGGMPQTFGTITISDGISMGTPGMKYSLVSREVIADAIETVVNGQSLDGLLATGGCDKNMPGAMMAIARLNVPAIFVYGGTIKPGRYKDQDLTIVSAFEAVGQHGAGKLSDEDLAGVERNACPGAGSCGGMFTANTMSSAFEAMGMSLPGSSTQAAEDPEKADSAARSAEVLLEAIHADRKPRDILTREAFENALAVVMAVGGSTNAVLHLLAIAHCANVPLALDDVERIRRKTPVLCDLKPSGRHVTTEFHAVGGTPQVMKILLNAGLLHRHCLTITGQTLSEVLADIPDAPPSNQTIIRPLDAPLYPQGHLAILKGNLAPEGSVAKITGLKSTSIRGPARVFESEEECLDAILAGGIQAGDVIVVRHEGPRGGPGMREMLAPTAAIIGAGLGDSVALITDGRFSGGTYGLVVGHVAPEAAQGGPIALVREGDIIEVDADRNRLALEVPEDELARRRSAWQAPPPRFDRGVLGKYSRQVGSASRGAVTDDFR

SEQ ID NO: 514 - DNA, 1686 bp, Thioalkalivibrio sp.
atgacccaggacaatcgacgcagccgcgtcgtcaccgaagggccacgccgcacccccaaccgcgccatgctcagggccgtgggcttcggtgacgacgacttccagcgccccatcgttggcattgccaacgcccacagcaccatcactccctgcaacatggggatcggggcactggccgaacgtgcggaatcggccgtacgagcctcgggcggcatgccgcagaccttcggcaccatcaccatctctgacggcatttcgatgggcaccccgggcatgaagtactccctggtgtcgcgcgaggtgatcgccgacgcgatcgagacggtcgtcaacggccagagtctggacgggctgctggccaccggcggctgcgacaagaacatgcccggcgccatgatggcgatcgcccggcttaacgtgcccgcgatcttcgtctacggaggcacgatcaagccgggacgctacaaggaccaggacctgacgatcgtcagtgcgttcgaggccgtcggacagcatggggcgggaaagctgtcggatgaagacctggccggcgtggagcgcaatgcctgcccgggagccggctcctgtggcggcatgttcacagccaataccatgtccagcgccttcgaggcgatgggcatgagtctgccgggctcgtcgacccaggcggccgaggacccggaaaaggccgactccgccgcccgttccgccgaggtcctcctggaggcgatccatgccgaccgcaagccgcgcgacatcctcacgcgcgaggccttcgagaacgccctggccgtggttatggccgtcgggggatcgaccaatgccgtgctccacctgctcgccattgcccactgtgccaacgtgccgttagctctggatgacgtagaacggatccgccggaaaaccccggtactgtgcgatctgaagccctccggtcgacacgtgaccacggaattccatgcggtggggggcacaccgcaggtcatgaagatcctgctgaacgccggtcttctgcacaggcactgcctgaccattaccggccagaccctaagcgaggtcctcgcagacatccctgatgcaccaccatcgaaccagaccatcatccgcccgctggatgcccccctgtacccgcaggggcacctggcgatcctgaagggcaatctggcgccggaaggcagcgtggccaagatcaccgggctcaagtccacttcgattcgcgggcccgcgcgcgtattcgaatccgaggaggaatgcctggacgccatcctggcgggcgggattcaggctggcgacgtcatcgtggttcgtcatgagggcccccgcggcgggcccggtatgcgcgagatgctcgcccccacggcagcgatcatcggcgcgggtctcggcgactccgttgcgttgattaccgacggacgcttctccggaggcacctacggtctcgtcgtcggacatgtcgctcccgaggcggcgcaaggtgggcccattgccctggtgcgcgagggcgacatcatcgaggtcgatgccgaccgtaatcgtctcgcgctcgaggtaccagaggacgaactggcgcgtcgccgcagtgcctggcaggcacccccgccgcgctttgatcgaggtgtgctcgggaagtacagccgtcaggtcggatccgccagtcgcggcgcggtcaccgacgactttcgctga

SEQ ID NO: 515 - protein, 560 aa, Flavobacteria bacterium
MAKELNKYSKHVTQDPTQPASQAMLHAIGLSKEDLKKPMIGIGSTGYEGNPCNMHLNDLAKEVKLGVQKANLTGLIFNTIGVSDGISMGTFGMRYSLPSRDIIADSMETVVQAMNYDGLATIVGCDKNMPGALMAMIRLNRPSIMVYGGTIASGCARGKKLDVVSAFEAWGEKVAGTIDEKAYQEVIENACPGAGACGGMYTANTMASAIEALGMTLPYNSSNPATGNEKPLDCVASGEALGLLIEKDLKPLDIITKKSLENAVRLIIVLGGSTNAVLHFLAIAKTANIDFTLEDFTRISSETPFLADLKPSGQYLMEDLHRVGGIPAVMKFMLQNDMLHGDCMTVTGKTIAENLQSVPDLIKDQDVIRPLNAPIKETGHIRILYGNLAEEGAVAKITGKEGVYFKGPAKVYEGEFLANDGIKAGEVKKGDVVVIRYEGPKGGPGMPEMLKPTAAIMGAGLGKEVALITDGRFSGGTHGFVVGHVSPEAQVGGTIGLVQDGDIITIDASSNTISLDIDIAELNKRKALWVAPELKVSSGSLYKFANIVSSASKGCVTDVF

SEQ ID NO: 516 - DNA, 1683 bp, Flavobacteria bacterium
atggcaaaagaattaaataaatacagtaaacacgttacccaagatccaacccagcctgcttcacaggcaatgcttcacgctattggtctttctaaagaagaccttaaaaaacctatgataggaattgggagtacaggatatgagggaaatccttgcaatatgcatttaaatgatttggctaaagaagtaaagttgggggtccagaaagccaatcttactggacttatctttaataccattggggtaagtgatggtatttcaatggggacctttggaatgcgctattcgttgccttctagggatattattgcagattctatggaaacagtagttcaggcaatgaactatgatggtttggctaccatagtaggctgtgataaaaatatgcccggtgctttaatggcaatgataagattaaatagaccttccataatggtttatggaggaaccatagcctcaggctgtgcaagaggaaaaaaattagatgttgtctcagcttttgaagcatggggggagaaagtagctggcactatagatgaaaaagcgtatcaggaagtaattgaaaatgcctgccctggagctggtgcttgtggtggaatgtatactgcaaatacaatggctagtgctattgaagctttggggatgactttaccgtataattcttctaaccctgccacaggcaatgagaaaccattggattgtgtagcgtctggcgaagccttaggcttactaatagaaaaggatttaaaaccattagatataatcaccaaaaagtctttagaaaatgcggtgagattaatcatcgttttaggaggttctaccaacgcggtattgcattttttggctattgcaaaaacagcaaatatagattttacgctagaagactttaccagaatttctagtgaaaccccgtttctcgcagaccttaagcctagtggtcaatatcttatggaagatttacaccgtgtgggaggtatacctgcggtaatgaaatttatgcttcaaaatgacatgcttcacggtgattgtatgacggttactggaaaaacaatagcagaaaacctccaatctgttccggatcttataaaagaccaagatgtcataagacccctaaatgcaccaataaaagaaactggacatattaggattctttacggtaaccttgcggaagaaggtgcagtagctaaaattacaggaaaagaaggggtttatttcaaagggcctgctaaagtgtacgaaggagagtttttagccaatgatggtataaaagcaggagaagttaaaaaaggagatgtggtggtcattcgttacgaaggcccaaagggaggaccaggaatgccagaaatgttaaagcctacagcagccattatgggtgcgggtcttggcaaagaggtcgctttaattacagatggacgtttttctggaggtacccacggatttgtagtaggacacgtgtctcctgaagctcaagttggaggaaccattggattggttcaagatggagacattattactatagatgctagctcaaacaccatttcgttagatatagatatagcagaactcaataagcggaaagcattatgggtagcccctgaacttaaagtcagtagtggtagtttatataaatttgcgaacatagtttcttctgcatctaaaggatgcgtaacagacgttttttaa

SEQ ID NO: 517 - protein, 558 aa, Flavobacteria bacterium
MELNKFSKAVTQDPTQPAAQAMLHAIGMTDEDFKKPLIGIASTGYEGNPCNMHLNDLAQDIKVGVNAQSLVGLVFNTIGVSDGISMGTPGMRFSLPSRDVIADSVETVVQAMSYDGVVTVVGCDKNMPGALMAMLRLNRPSILVYGGTIAAGCHNDKELDVVSAFEAWGEKVAGKIDEKEFKSVIRNACPGAGACGGMYTANTMASAIEACGMALPYNASNPAVSKDKKEECLALGVHLRNLLELDLKPRDIVTRKALENALRLIAVLGGSTNAVLHFLAIAKAAQIDLTIDDFQKISDTTPFLADLKPSGKYLMKDLHQVGGVPAVLKYMLEQGMLHGDCMTVTGKTLAENLADVPSLKENQKVIRPIDQPIKATGHIRILKGNLATGGSVAKITGKEGLLFKGPARVFNGEYAANDGIREGKVKAGEVVVIRYEGPKGGPGMPEMLKPTAAIMGAGLGNSVALITDGRFSGGTHGFVVGHIVPEAQEGGAIGLVQDGDEITIDAEKNTISVALSDAELADRKAAWVKPPYKFKQGVLYKYIKSVATASEGCVTDSE

SEQ ID NO: 518 - DNA, 1677 bp, Flavobacteria bacterium
atggagctcaataaattcagcaaagcagttacacaagatccaacgcagccagcggcacaagccatgttgcatgcgattggaatgaccgatgaagactttaagaaaccattaattggtattgcttctacaggttacgaggggaatccctgtaacatgcatctaaacgatcttgcacaagatataaaagtgggtgtcaacgcacaatcattagtgggtttagtttttaataccattggtgttagcgacggtatttctatgggtactcctggaatgcgtttctctcttccttcacgagatgttattgctgattcagtagaaacagtggttcaagcaatgtcttatgatggcgttgtcactgttgtgggctgtgataaaaatatgccaggcgcactgatggcaatgttacgtttgaaccgtccctcgattttagtctatggaggtactattgctgctggatgtcacaatgataaagagttggatgttgtttctgcatttgaagcatggggcgaaaaagtagcagggaagattgatgaaaaagagtttaagagtgttatccgaaatgcctgccctggtgctggagcttgcggaggtatgtatactgccaacaccatggcttcagccatagaagcttgtggaatggcattgccctataacgcatccaatccagcagttagtaaagataagaaagaagagtgtcttgctttgggggttcatctcagaaaccttttggagcttgatttaaaacccagagatattgttactcgcaaagcattagaaaatgcgttaagattgattgctgttttgggaggttctacaaatgcagtacttcactttttagctattgccaaagcggctcaaatagacttgacaattgatgatttccaaaaaattagtgatacgactccctttttagctgatttgaaaccaagtggaaaatatttaatgaaagaccttcaccaggttgggggagtccctgccgtgttgaagtatatgttggaacagggtatgctccacggtgattgtatgaccgttactggaaaaacgttagctgaaaatttagccgatgttccaagtctgaaagaaaaccaaaaagtcattcgaccgattgaccaacccattaaagcgacaggacatattcgtattttaaaagggaacttagctacgggagggtctgtagcaaaaatcacaggaaaagaaggcttgttattcaaagggcctgcgcgagtttttaatggcgaatatgccgccaatgatggtatccgtgagggtaaggttaaagctggggaagtggtcgttattcgttatgaaggacctaaaggaggtcctggaatgcctgaaatgttaaagcctacagctgccattatgggagctggcttaggaaatagcgtcgctttgattaccgacggacgtttttcaggaggtacacatggatttgtagtaggacatattgtcccagaggcccaagagggaggtgccattggacttgttcaagatggagatgagatcaccatagatgcagaaaaaaatacaattagtgtggcattgtccgatgccgaactcgctgatagaaaagctgcatgggtaaagccaccttacaagtttaagcaaggggtattatataaatatattaaaagtgtagcaacagcttctgaaggttgtgttacggattccgagtaa

SEQ ID NO: 519 - protein, 563 aa, Nostoc azollae
MSENIKSKFITQGVQRSPNRAMLRAVGFQDADFNKAIVGIANGYSTITPCNMGINQLAQRAEMSLRNAGAMPQVFGTITISDGISMGTEGMKFSLVSREVIADSIETACTGQSMDGVLAIGGCDKNMPGAMLAIARMNIPAIFVYGGTIKPGHYDGKDLTVVSSFEAVGQHSAGKIDETELLEIERRACPGAGSCGGMFTANTMSSAFEAMGMSLPYSSTMAAEDAEKADSTEKSAFILVEAIRKQILPRQLITRKSIENAISVIMAVGGSTNAVLHFLAIARAAGVELTLDDFETIRARVPVLCDLKPSGRYVATDLHKAGGIPQVMKILLVRDLLHGDCLTISGQTVAEVLADIPAEPSPKQNVIRPWDRPIYAQGHLAILKGNLGTEGAVAKITGVKKPIITGPARVFESEESCLDAILAGKIKAGDVIIIRYEGPKGGPGMREMLAPTSAIIGAGLGDSVGLITDGRFSGGTYGMVVGHVAPEAAVGGNIALVEEGDSITIDANSRLLQVNISDAELASRRANWQPRPPRYTKGVLAKYAKLVSSSSVGAVTDLDLFGN

SEQ ID NO: 520 - DNA, 1692 bp, Nostoc azollae
atgtcagaaaatattaagagtaaatttatcacacaaggggtacagcgatcgcctaaccgggctatgttgcgggctgttggttttcaagatgcagacttcaacaaagccatagtcggtattgctaatggttacagtaccatcaccccctgtaatatggggattaaccaactagcacaaagggcagaaatgagcctcagaaatgcaggtgcaatgccccaagttttcggcacaattaccatcagtgatgggatttcaatgggaacagaggggatgaagttctctctggtgtcacgggaagtgatcgcagattccattgaaactgcatgtactggccaaagtatggatggtgttctggctattggtggttgtgacaaaaatatgccaggggcaatgttagcaatcgctcgcatgaatatccctgctatctttgtttatggtggcacaatcaaacccggacactacgatggcaaagatttaaccgttgttagttcctttgaagccgtcggccaacacagcgccggcaaaattgacgaaaccgaacttttagaaattgaacgccgtgcttgtcctggtgctgggtcctgtggtggaatgttcacagctaataccatgtcttcagcctttgaagcaatgggaatgagtttaccttattcctcaaccatggccgcagaagatgccgaaaaagcggatagcacagagaaatccgcctttatcttagtcgaagccatccgtaagcaaatattaccccggcaacttatcacccggaaatctatcgaaaatgccatatctgtaattatggccgttggtggttctaccaatgcagttttacattttttagcgatcgcccgcgcagctggtgtagaactaactttagacgactttgaaaccatccgggcccgtgttccagttttgtgcgatttaaaacccagtggtagatacgtagccacagacttgcataaagctggtggtattcctcaagtcatgaaaatcttattagttcgtgatttactgcatggtgactgtctaactatctctggtcaaactgtagccgaagtcttagcagacataccagcagaaccatcacccaagcaaaatgtaattcgtccttgggatcgtcccatctatgcacaaggacatttagctattctcaaaggtaacttaggtactgaaggtgcagttgctaaaattactggtgtgaaaaaacccatcatcaccgggccagcgagagtatttgaatcagaagaatcttgcttagatgcaattttagcaggtaagattaaagcaggtgatgtgatcatcatccgttacgaaggtccaaaaggtgggcctggtatgcgggaaatgttggctcccacctcagcaattattggtgcgggattaggtgattctgtgggcttaattacggatggacgcttttctggcggtacttatgggatggtagttggtcacgtcgctccagaagctgcagtcggcggtaatattgccttggtagaagaaggtgatagtatcaccattgatgctaattctcgattattacaagtgaatatatcggatgcagaattagctagtcgtcgtgctaactggcaaccgcgtccaccacgttatacaaaaggggtgctggcgaaatatgccaagttggtatcttctagtagtgttggtgctgttacagacttagatttgtttggtaattaa

SEQ ID NO: 521 - protein, 562 aa, Acidobacterium capsulatum
MSSEQNGSAKKNSVALTEGPNRAPARAMLRAIGFTRDDLRKPIIGIANTWTEIGPCNFHLRQIAEAVKQGIREAGGTPMEFNTVTISDGITMGTEGMKASLVSREVIADSIELVTRGNLFDGLVCIAGCDKNLPGTVMALARLDVPGLMLYGGSIAPGHLNGKDLTVQDVFEAVGSHAAGKLDDAGLEAVEANACPGAGACGGQFTANTMAMACEFMGISPMSISGVPAFLPEKLASAKEAGKLVLELAKRDLRPSQLITKESLENAIASVAASGGSTNAVLHFLAIAHERGIALSIDDFDRISEKTPLLCDMKPGGKYVAADYQKAGGSRLLAKRLIEGGYIHSDCLNASGRTLAEEAALAVEEPGQKVIFPATNALKPTGGLVILKGNLAPEGCVIKVAGHSRLTHRGPARVFDREQDAFAAVENGSIQPDDVMVIRYEGPKGGPGMREMLGVTAAIAGIPALSETVALLTDGRFSGATRGLMAGHVSPEAAVRGPIAAVRNGDMIHFDIPNRRLDVELTDAQIEERLKDWKEPAPHFSRGVFKKYVDTVSSAARGAVTN

SEQ ID NO: 522 - DNA, 1689 bp, Acidobacterium capsulatum
atgagcagcgaacagaacggatcggcgaagaagaacagtgtggccctcacggaagggccgaaccgcgccccggcgcgcgccatgttgcgcgcgattggctttacccgcgatgacctgcgcaagcccatcatcggcattgcgaatacgtggaccgagattggcccctgcaactttcacctgcggcagattgccgaggccgtgaagcaaggcattcgcgaagcgggcggcacgccgatggagttcaacacggtgacgatttcagacggcatcacgatgggcaccgaaggcatgaaggcctcgctggtgagccgcgaagtgattgccgactcgattgaactggtcacgcgcggcaacctttttgacggcctcgtctgcattgcgggctgtgacaagaatctgccgggcacggtgatggcgctggcgcggctcgatgtgccggggctgatgctgtatggcggctcgattgcgccaggacacctgaacggcaaggatctcacggtgcaggatgtattcgaggccgtgggctcccatgccgcaggtaagctggatgacgcgggcctggaggcagtggaagcgaatgcctgcccaggcgcgggcgcgtgcggcggacagttcacggcgaacacgatggcgatggcctgcgagttcatgggcatttcgccgatgtcgatctctggcgtgccggcgtttctgcccgagaagctggcgagtgcgaaagaagccggaaagctggtgctggagttggcgaagcgcgatctgcgcccgagccagttgatcacgaaggagtcgcttgaaaatgcaattgccagcgtggcggcttcgggcggttcgacgaatgcggtgctgcactttctggcgattgctcatgagcgcggcattgccctgtcgattgatgatttcgaccgcatcagcgagaagactcccctgctctgcgacatgaagccgggcggcaagtatgtggctgcggattaccagaaagcgggcggcagccggttgctggcgaagcgcctgatcgagggcggatacatccacagcgactgcctcaatgcgagcgggcgcacgctggccgaagaggctgcgctggccgtggaagagccgggacaaaaagtaatctttccagctacaaatgcgctgaaacccacgggcggcctggtgatcctcaagggcaatcttgctcctgaaggttgcgtgatcaaggtcgccgggcacagccgcctcacgcatcgtggaccagcgcgggtgtttgatcgcgagcaggatgcgtttgcggcggtagagaacggcagcattcagcccgatgacgtgatggtgattcgctatgaggggccgaagggtggtccgggcatgcgcgagatgctcggcgtgacggcggcgattgccggcattccggcactgagcgagacggtggctctgctgacggatgggcgcttctcgggcgcgacacgcgggttgatggcgggccatgtgtctcctgaagccgcggtgcgcgggccgattgcggcggtgcgcaatggcgacatgattcacttcgatattccaaaccgcaggctcgatgtggaactaacggacgcacaaattgaggaacgcctgaaggactggaaggaacctgcgccgcatttttcgcggggtgtgttcaagaagtatgtggatacggtgtcgtcggcggcgcggggcgcggtaacgaactag

SEQ ID NO: 523 - protein, 569 aa, Gemmatimonas aurantiaca
MSFPQLPSRHATSGPERAPHRAFYYAMGLTAEEIARPIVGVVSSWNEAAPCNIALKRQAEVAKRGVIAGGGTPREFTTITVTDGIAMGHAGMKASLVSRETIADSVELTVRGHCYDALVGIAGCDKSLPGLMLAMVRLDVPSIFLFGGSIMPGRYKDRDVTVLDVFEAVGSYAAGGITLDELTALEKVACPGAGACGGQYTANSMAYVSEAIGLALPGSASPPATYESRDAFAERSGQVVMDLVRSGLRPRQIVTRKSLENAAAVVAATGGSTNATLHLPAIAHEAGISFDLFDVAEVFKRTPLIADLKPGGKYLAKDVHDIGGVSIVLKSLLDGGFLHGDCITVTGKTLAENLADVVIPENQKVVMPVSQAISQTGGLVGLRGNLAPDGAVVKVAGLKHLTHSGPARVFDSEDDCFAAVMERRYTAGDVLVIRYEGPVGGPGMREMLSTTSAIYGQGLGETVALITDGRFSGATRGMCIGHVGPEAAMGGAIGLLRDGDIIDIDASAGTLSVRLTDEELVARRAEWTPRKTDFQSGAIWRYAQTVGPARNGAVVHPGGKAETHVYADA

SEQ ID NO: 524 - DNA, 1710 bp, Gemmatimonas aurantiaca
atgtcctttcctcagcttcccagccggcacgcgacgtccggccctgaacgtgcgccccatcgtgccttctactacgcgatgggactcacggcggaagagattgcgcgccccatcgtgggtgtggtgtcgagttggaacgaagcggcgccctgcaacatcgcgctcaagcggcaggccgaagtggccaagcgtggcgtgattgccggtggcggcacgccgcgggaattcaccaccatcacggtcaccgatggtatcgcgatgggacatgccggcatgaaagcgtcgctggtgagtcgtgaaaccatcgccgactcggtggaactcacggtgcgcgggcactgctatgatgcgctggtgggtatcgcgggctgtgacaagtcgctgccggggctcatgctggccatggtgcgtctcgatgtgccatcgatctttctgttcggcggttccatcatgccggggcgctacaaggaccgcgatgtcaccgtgctcgatgtgttcgaggcggtgggatcgtatgctgcaggcggcatcacgctcgacgaactcaccgcactcgaaaaggttgcgtgcccaggagccggagcgtgcggtggacagtacacggccaacagcatggcctacgtgtccgaagcgatcggactcgcacttccaggctcggcgagccctccggcgacgtatgagtcacgtgatgcctttgccgaacggtcgggccaggtggtgatggatctcgtgcgcagtggactgcgtccgcgtcagattgtcacgcgcaagtccctcgaaaatgccgcggcggttgtcgcggccacgggtggttccaccaatgccacgctgcacttgccggcgatcgcgcacgaagcgggcatttcgttcgacctgttcgatgtggccgaggtgttcaagcgcacgccgctgatcgccgatctcaagccgggtgggaaatatctggccaaggatgtgcacgacatcggtggtgtgagcatcgtgctcaagtcgctgctcgatggtggtttcctgcatggcgactgcatcacggtgaccggcaagacgttggccgagaatctggccgatgtggtgatcccggaaaatcagaaggtggtgatgccggtgtcgcaggccatctcgcagacgggcggtctggtgggattgcgtggcaacctggcgcccgatggtgccgtggtgaaggtggcaggactcaagcacctcacacacagtggcccggcgcgggtgttcgatagtgaagacgactgttttgcggccgtgatggaacggcgctataccgccggtgatgtgctggtgattcgctatgaaggaccggtgggtggtccgggtatgcgcgagatgttgtccaccacctcggcgatctacgggcagggactgggtgagactgtggccctcatcaccgatggccggttctcgggcgcgacccgtggcatgtgcatcggtcacgtcggacccgaggccgccatgggcggcgccatcgggttgctgcgcgatggcgatatcatcgacattgatgccagtgccggcaccttgtcggtacgactcaccgacgaggaactggtggcgcgccgcgcggagtggacgccgcgcaagaccgacttccagagtggggcaatctggcgatacgcacaaacggttggcccggcgcgcaatggtgcggtggtgcaccccggtggcaaagccgaaacgcacgtgtacgcggacgcgtga

SEQ ID NO: 525 - protein, 562 aa, Gemmatimonas aurantiaca
MTRRFRSATIYEGTVRATTHAFLEALGQSAEEIRRPHIGVFHTGGEMSPCNMNLRDQAQHAKTGIYAGGGMPHECPVVSVSDGLSIAHSGMRYSLVSRELIADSVEASTEGHQWDGIFAIGGCDKNLPGLMMGMLRCNVPSVFVHGGAALPGHWQGRDTNVAETYETIGKVYAGEATTEQLEAIAHACLPTAGSCAGQFTANTMGMVSEAIGLAPIGSSMVPAVFSERAPLMRRAAAALMRAVMADAPRPRDIVTRDALENACAVVSATGGSTNAALHIPAMAHEAGITFTLDDVAAVFRRTPLIADLQPGGKYLARDLHYAGGAGVVLRALLDAGALHGDCITFTGRTLAEELENAAPVDGRVVHAVEQALSADGGVTVLHGNLCPDGALLKTAGLGTLVHRGPARVFESEEAALVAVRDQLYAAGDVLVIRNEGPRGGPGMREMLGITALLYGQGMGAKVALLTDGRFSGATRGLCIGHAGPEAADGGPIAVLRDGDIITIDARPDARSIRVELSDEALAARLSALPAHQIPAHARGGLLQKYLKLVGPAHLGATTHSGL

SEQ ID NO: 526 - DNA, 1689 bp, Gemmatimonas aurantiaca
gtgacccgtcgattccgttcggccacgatctacgaaggcacggttcgcgccacgacacacgcatttctcgaggcgttggggcagagcgctgaagagatccggcgtccgcatatcggcgtgtttcacaccggtggcgagatgagtccgtgcaacatgaacctgcgcgaccaggcgcagcatgccaagacgggcatctacgccggcggtggcatgccgcacgaatgtccggtggtgtcggtgtccgatggcttgtccatcgcacacagcggcatgcgctactcgctggtgtcacgcgagctgattgccgacagtgtggaagccagcaccgaagggcatcagtgggacggcatcttcgcgattggcggctgcgacaagaacctgcccggcctcatgatgggcatgctgcgctgcaacgtgccatcggtgttcgtgcatgggggggccgcactgcccggacattggcagggacgtgacaccaacgtggccgagacgtatgagaccatcggcaaggtgtacgccggtgaagccacgaccgagcagctcgaagcgatcgcccatgcctgcctgccgacagcgggatcctgcgccggccagttcaccgccaacaccatgggcatggtgtcggaagccatcggactggcaccgattggttcgagcatggtgcccgcagtcttcagtgaacgtgccccgctcatgcgtcgcgccgcagcggcattgatgcgcgccgtgatggccgatgcaccgcgtccacgggatatcgtgacccgcgacgcgttggagaatgcctgcgcggtggtatcggcgaccggcggatccaccaacgccgcgctgcatatcccggcgatggcacatgaagccggtatcacgttcaccctcgatgatgtggccgcggtgtttcgtcgcacgccactcatcgccgatctgcagccgggcggtaaatacctggcgcgtgacctgcactacgccggcggcgctggtgtggtgttgcgtgcgctgctcgacgcaggcgctctgcacggtgattgcatcacgttcacaggacgtacgctggccgaagaactcgaaaacgccgcgccggtggacggacgtgtggtgcatgccgtggagcaggcattgtcggccgatggtggcgtgaccgtgctgcatggtaacctctgccccgatggcgccctgctcaagaccgccggcttgggcacactggtgcaccgtggaccggcacgggtgttcgagagtgaagaggcggcattggtcgcggtgcgcgaccagctctatgctgccggcgatgtgctggtgatccgcaacgaaggaccgcgcggcggtcccggcatgcgggagatgctgggcatcaccgccctgctgtacggtcagggcatgggcgccaaagtggcgctactcaccgatggccgtttcagcggcgccacccgaggcctgtgcatcggccacgccggacctgaggccgccgacggtggcccgatcgccgtgctgcgtgacggtgatatcatcaccatcgatgcgcggccggatgcacgcagcattcgcgtggaactcagcgatgaagcgctcgctgcacgactatcggcgcttcccgcccatcagatccctgcgcatgcgcgcggcgggctactgcagaagtacctgaagctggttggccccgcgcatctcggagcgaccacacacagcggcctgtaa

SEQ ID NO: 527 - protein, 564 aa, Rhodococcus erythropolis
MTEPDIKPRSRDVTDGLEKTAARGMLRAVGMGDDDWVKSQIGVASSWNEITPCNLSLDRLAKAVKEGVREAGGFPLEFGTISVSDGISMGHEGMHFSLVSREVIADSVETVMQAERLDGSVLLAGCDKSLPGMMMAAARLDLASVFLYAGSTLPGVAKLSDGSEREVTVIDAFEAVGACSRGLMSRADVDTIERAICPGEGACGGMYTANTMASAAEAMGMSLPGSASPPAPDRRRDGFARESGKAVVELLRRGITARDILTKEAFENAIAVVMAFGGSTNAVLHLLAIAHEAYVPLTLDDFARVGAKVPHLADVKPFGKHVMTDVDRIGGVPVIMKALLDAGLMHGDCLTVTGKTVAENLAHITPPDPDGKVLRAMNKPIHPTGGITILKGSLAPGGAVVKSAGFESDVFVGTARVFERERAAMDALEDGTITGGDVVVIRYEGPKGGPGMREMLAITGAIKGAGLGKDVLLLTDGRFSGGTTGLCVGHVAPEAVDGGPIAFVRDGDQIRLDVGTGQLELLVDDSELEARKKGWEPLPPRYTRGVLAKYSKLVGSASGGAVCG

SEQ ID NO: 528 - DNA, 1695 bp, Rhodococcus erythropolis
atgaccgaacccgacatcaagcccagaagtcgtgacgtcaccgacggactcgaaaagaccgcagcgcgcggcatgttgcgtgcagtaggaatgggtgacgacgactgggtcaagtcgcagatcggcgtcgcctcgtcctggaacgagatcacaccgtgcaacctgtccctcgatcgcctggccaaggccgtcaaggaaggtgtccgggaggccggtggattccccctcgaattcggcaccatctccgtttccgacggcatttcgatgggtcacgagggcatgcacttctccctcgtctcccgtgaagtgatcgcggacagcgtcgagaccgtcatgcaggccgagcgcctcgacggatcggttcttctcgccggctgcgacaagtcgttgcccggcatgatgatggcggcggcccgcctcgacctcgccagcgtgttcctgtacgccggttccaccctccccggcgtcgccaaactttccgacggcagcgagcgggaagtcaccgtcatcgacgcgttcgaggctgttggcgcctgctcgcgtggactgatgagccgcgccgacgtcgacaccatcgaacgggcgatctgcccgggcgaaggcgcgtgcggcggcatgtacaccgcaaacacgatggccagcgccgccgaggccatgggaatgtcgctgcccggcagcgcttcaccgcccgcaccggaccgtcgccgcgacggattcgcccgcgagagcggcaaagccgtggtcgaactcctgcgtcggggcatcaccgccagggacatcctcaccaaagaagcgttcgagaacgccatcgcagtagtcatggcgttcggcggatccaccaatgcggtgctccatctcctcgcgatcgcgcacgaagcgtacgtcccgctgacgctcgacgacttcgctcgcgtcggcgcgaaggtcccgcacctcgccgacgtcaagcccttcggaaagcacgtcatgacggacgtcgaccgtatcggcggcgtccccgtcatcatgaaagcattgctcgacgcgggactcatgcacggagattgcctgaccgtcaccggcaagactgttgcggagaacctggcgcacatcaccccgcccgatccggacggcaaggtcctgcgggcgatgaacaagcccattcacccgaccggaggcatcacgatcctgaagggctcgctcgctcccggcggcgcggtggtcaaatcggcaggattcgagtctgatgtattcgtcggcactgcacgggttttcgaacgtgaacgtgccgcaatggacgcgctcgaagacggaaccatcactggtggcgacgtcgtcgtcatccgctacgagggcccgaagggtggtcccggaatgcgcgagatgctggccatcacgggcgcgatcaagggtgcgggtctcggcaaggacgtcctgctgttgacggacggacgattctcgggcggcaccaccggcctgtgtgtcggacacgttgcgcccgaggccgtcgacggcggtcccatcgcgttcgttcgcgacggcgaccagatccggctcgacgtgggtaccggacaactcgaattgttggtcgacgactccgaattggaagcccgcaagaagggctgggagccgttgccgcctcgctacacacgtggtgtgttggccaagtactccaagctcgtgggatcagcctcgggtggagcagtgtgcggctga

SEQ ID NO: 529 - protein, 564 aa, Deinococcus deserti VCD115
MTDTAQKRKLNWNSHHITQGDERAPNRAMLRAVGFQDGDFEKPIIGVAHAQSNITPCNNGLGELADHITGAIHEGGGMPQIYGTITVSDGISMGTEGMKCSLVSREVIADSIETVSRGQSHDGVIVVGGCDKNMPGAMIGIARLNIPAIFVYGGTIKPGHYNGQDLTIVSVFEAVGAFGAGKISRHDFEQIEKRACPGNGSCGGMYTANTMSSAFEAMGMSLPHSSTMSAVDAEKAVSSADSARALLKLIEADIRPLDILTREAFENAITVIMAVGGSTNAVLHLMAVAHACNIDLTLADFERIRERTPVFCDLKPSGRYVATDLHEVGGIPRVMKMLLKEGLLHGDCLTVTGKTVAENLADEPDAPNADQDVIRPFDQPIYTQGHLAILRGNLAPNGSVAKISGLKQIKITGPARVFDSEEACMEAIMGDRIKAGDVLVIRYEGPKGGPGMREMLSPTSAIIGKGLGDSVGLITDGRFSGGTFGLVVGHVAPEAFVGGPIALVHEGDTIELNAETLNLTLHVPDEELARRRAEWSPPKPNYERGVLAKYAKLVSGAEVGAYTD

SEQ ID NO: 530 - DNA, 1695 bp, Deinococcus deserti
atgaccgacacggcacagaagcgcaagctgaactggaacagtcaccacatcacgcaaggcgacgagcgtgccccaaaccgcgcgatgctgcgcgctgtgggcttccaggatggtgatttcgaaaagccgattattggcgtggcgcacgcccagagcaacatcacgccgtgtaacaacggcctgggagagctagcagaccacatcaccggagctattcatgaagggggcggcatgccccagatctacggcaccatcacggtgtccgacggcatcagcatgggtactgagggcatgaagtgctcgctggtgagccgcgaggtgattgccgactccattgaaaccgtctcacgcggacagtctcatgacggcgtgattgtggtgggcggctgcgacaagaacatgccgggcgccatgatcggcattgcccggctgaacattccggccatcttcgtgtacggcggcaccatcaaacctggacactacaacgggcaggacctgactattgtcagcgtattcgaggcggtgggggcgttcggcgccggcaagatcagccggcacgatttcgagcagatcgaaaaacgtgcctgccccggcaacggctcgtgcggcgggatgtacaccgccaacaccatgagcagcgccttcgaggcgatgggcatgagcctgccgcactccagcaccatgagcgctgtggacgccgagaaggccgtcagcagcgccgacagtgcacgcgcgctgctgaaacttatcgaggcggatatccgcccactggacatcctgacccgcgaggctttcgagaacgccatcaccgtgatcatggccgtgggtggaagcaccaacgccgtcctgcacctgatggccgtggcgcacgcctgcaacattgacctgacgctggcagactttgagcgcatccgcgagcgcacaccggtcttctgtgatctcaagcccagcggacggtacgtggctaccgacctgcacgaggtaggcggcattccgcgcgtgatgaagatgctgctgaaagagggcctgctgcacggcgactgcctgactgtgaccggtaagacggtggcggaaaacctggcagatgagcctgatgcgccgaatgcagaccaggacgtcatccgtcccttcgaccagccgatctacacgcagggtcacctggcaatcctgcgcggaaacctggcgccgaatggcagcgtggccaagatcagcggcctgaagcagatcaagatcaccgggcccgcgcgggtattcgactcggaagaagcctgcatggaagccatcatgggcgaccgcatcaaagccggtgacgtgctggtcatccgctacgagggtcccaaaggcggccccggcatgcgcgagatgctctctccgacgagtgccatcatcggcaagggtctgggcgacagtgtcggcctgatcacggacggacgcttctccggaggaaccttcggcctggtggtcggccatgtcgcgccggaagcctttgtcggcggccctatcgcgctggtccacgagggcgacaccatcgaactgaacgccgagaccctcaacctcacgctgcacgtgccggatgaggaactggcccgccgccgcgccgaatggagcccgcccaagcccaactacgaacgcggagtcctggccaagtacgccaagctggtcagcggtgccgaggtcggcgcgtacaccgactga

SEQ ID NO: 531 - protein, 564 aa, Rhodococcus opacus
MNTPDPKPRSRDVTDGLEKTAARGMLRAVGMGDDDWGKSQIGVASSWNEITPCNLSLDRLAKAVKDGVHAAGGYPLEFGTISVSDGISMGHEGMHFSLVSREVIADSVETVMQAERLDGSVLLAGCDKSLPGMLMAAARLDLSSVFLYAGSILPGIAKLSDGTELDVTIIDAFEAVGACSRGLMSREDVDAIERAICPGEGACGGMYTANTMASAAEALGMSLPGSASPPATDRRRDGFARRSGEAVVELLRRGITARDILTKEAFENAIAVVMAFGGSTNAVLHLLAIASEAGVELNLGDFSRVGARVPHLADVKPFGKHVMKDVDHIGGVPVIMKALLDAGMLHGDCLTVTGRTMAENLADIAPPDPDGKVLRAMSSPIHPTGGITILEGSLAPGGAVVKSAGFDSDVFTGTARVFERERAAMDALEDGTITNGDVVVIRYEGPKGGPGMREMLAITGAIKGAGLGKDVLLLTDGRFSGGTTGLCVGHVAPEAVDGGPIAFVRDGDQIRLDVGTGTLELLVDEKELAGRKDGWEPLPPRYTRGVLAKYTKLVGSASGGAVCG

SEQ ID NO: 532 - DNA, 1695 bp, Rhodococcus opacus
atgaataccccggatccgaaaccccgcagccgcgacgtcaccgacggactggagaagaccgcggcacgcggcatgctccgtgcggtggggatgggcgacgacgactggggcaaatcccagatcggcgtggcctcctcctggaacgagatcaccccctgcaacctctcgctcgaccggctcgcgaaggccgtcaaggacggcgtccacgcggcgggcgggtatcccctcgagttcggcaccatctccgtgtccgacggcatctcgatgggacacgagggcatgcacttctccctcgtgtcgcgcgaagtgatcgccgacagtgtggaaacggtgatgcaggccgaacgcctcgacgggtcggtgctgctcgccggttgcgacaagtcgctgcccggcatgctgatggccgcggcccgcctcgacctgtcgagcgtgttcctctacgcggggtcgatcctgccgggcatcgccaaactgtccgacggcaccgaactcgacgtcaccatcatcgacgcgttcgaggcggtcggcgcgtgttcgcgcggactgatgagccgcgaggacgtcgacgccatcgagcgcgccatctgccccggcgagggtgcctgcggcggcatgtacaccgccaacacgatggccagtgccgccgaggcgctgggcatgtcgctgcccggcagcgcgtccccgccggccaccgaccgccgtcgcgacgggttcgcgaggcgcagcggcgaggccgtcgtcgaactcctccgccgcggcatcaccgcccgggacatcctcaccaaggaggcgttcgagaacgccatcgccgtggtcatggcgttcggcggttccaccaacgccgtcctgcacctgctggccatcgccagcgaagccggagtggaactgaacctcggcgacttctcccgcgtcggcgcccgcgtcccgcacctcgccgacgtcaagccgttcggcaagcacgtgatgaaggacgtcgaccacatcggcggcgtccccgtcatcatgaaggccctcctcgacgccgggatgctgcacggcgactgcctgaccgtcaccggccggacgatggccgagaacctcgccgacatcgcgccgcccgacccggacggcaaggtgctgcgcgcgatgagttcgccgatccacccgaccggcggcatcacgatcctcgagggttccctcgccccgggcggcgcggtggtgaagtccgccgggttcgactccgacgtcttcaccggcacggcccgcgtcttcgaacgcgagcgcgccgcgatggacgccctcgaggacggcaccatcacgaacggcgacgtcgtcgtcatccgttacgagggccccaagggcggtcccgggatgcgcgagatgctcgcgatcaccggcgccatcaagggggccggcctcggcaaggacgtcctgctcctcaccgacgggcgattctccggtggcaccaccggcctgtgcgtcgggcacgtggcgccggaggccgtcgacggcggtcccatcgcgttcgtccgcgacggcgatcagatccgcctggacgtcggaacgggcacgctggaactgctcgtcgacgagaaggaactggccggccgcaaggacgggtgggagccgctgcccccgcgctacacccgcggggtcctggccaagtacacgaagctcgtcggttcggcctcgggcggcgcggtctgcgggtag

SEQ ID NO: 533 - protein, 560 aa, Chryseobacterium gleum
MLNKYSKTFTQNSEQPAAKAMLYGIGFTEEDMHKAQVGIASMGYDGNTCNMHLNDLAQVVKKGTWNHGLAGLIFNTIGVSDGMSNGTDGMRYSLVSRDVIADSIEAICGAQYYDGLIALPGCDKNMPGTIIAMGRLDRPSIMVYGGTIAPGCYKGEALNIVSAFEALGKKIAGEITEEDFDGVVKNSCPGAGACGGMYTANTMASAIEALGMSLPYSSSNPALSKEKQEECLEAGKYLKVLLEKDIKPSDIMTRKAFENALRLIVILGGSTNAVLHFIAMAKSVGVPLTQDDFQKMSDHTPVLADLKPSGKYLMQDLHEHGGTPAVMKYLLEQGLLHGDCLTVTGKTVAENLADVPGLDFNTQKIIKPLSEPVKATGHLRILYGNLAEKGSVAKITGKEGERFVGKARVFDGEKNLIRGIQDGTVQHGDVIVIRHEGPKGAPGMPEMLKPTSALIGAGLGSSVALITDGRFSGGTHGFVVGHITPEAHEGGLIAFVHNDDLIEIDAVNNTIQLKVSEEEIERRKKGWQKPPLKVQKGLLYKYALTVSSAAEGCVTDEITQ

SEQ ID NO: 534 - DNA, 1683 bp, Chryseobacterium gleum
atgttaaataaatattcaaaaacattcacgcaaaacagtgaacagcccgccgccaaggccatgctatacgggataggatttacagaagaagatatgcacaaggctcaggtgggaattgccagtatgggctatgacgggaacacctgtaatatgcatctgaatgatcttgctcaggtagtaaaaaagggaacatggaaccacggattagccggattgatttttaataccatcggcgtaagtgacggaatgagcaacggaacagacggaatgcgctattccctggtaagccgtgatgtgattgcagacagtatcgaagcgatctgcggtgcacagtattacgacggactgattgctctgccaggctgcgacaaaaatatgcccggaaccataatcgcaatgggaaggctagacagaccctccattatggtgtacggaggaactattgcaccaggctgttacaaaggagaagcacttaacatcgtttctgctttcgaagcgttggggaaaaagattgcaggagaaatcactgaagaagatttcgacggtgtggtgaagaactcctgtcccggagctggagcatgtggtggaatgtataccgccaatacaatggcttctgctatagaggcattaggaatgagtcttccgtattcctcttccaatccggccttaagcaaagaaaagcaggaagaatgtcttgaggccggaaaatacctgaaagtacttctggaaaaagacattaaaccttccgatatcatgacccgtaaagcatttgaaaatgcacttcgccttattgttattttgggaggaagtacaaatgctgttctgcattttattgccatggcaaaaagtgtaggggttcctcttactcaggacgatttccagaagatgagcgatcatactccggtattggcagacctgaagccgagtggaaaatatctgatgcaggatctgcatgaacacggaggaaccccggcggtgatgaaatatttactggaacagggattactgcatggagactgccttaccgtcaccggaaaaacagtagccgaaaatctggcagatgttccggggttggattttaatactcagaaaattataaagccactttcagaacctgtaaaagctaccggacacctgagaatattgtacggaaaccttgcggaaaagggaagtgttgccaaaatcacaggaaaagaaggtgagcgctttgtagggaaagcccgtgtgtttgatggcgaaaaaaatctgatcagaggaattcaggatggaactgtacagcacggtgatgttattgtcatccgtcacgaaggcccgaaaggggcgcccggaatgccggaaatgctgaagcctacaagtgcattgatcggagccggtctgggaagcagtgttgctttaatcacggatggaagattcagtggaggaacccatggttttgttgtaggacacatcacaccggaagcccatgaaggaggtctgattgcttttgtacacaatgatgacctgatcgaaatagatgcggtaaacaataccatacagctcaaagtttcagaagaagaaatagaaagaagaaaaaaagggtggcaaaaacctccccttaaagtacagaaaggattgctttataaatatgcattaacagtatcatcagctgcagaaggctgtgtaacggacgaaatcactcaataa

SEQ ID NO: 535 - protein, 566 aa, Thermobaculum terrenum
MSDASTGFDPRHKSRTIVEGRERAGARSMLRAIGWTDEDFHKPVIGVAHCWIETMPCNYGHRELAEHVKRGIRDAGAVPVEVNTVAISDGITMGTEGMKASLISREVIADSIELVGRGHMFDAMVILVACDKTIPAGAMALARLDIPGFLIYTGTIYPGKYKGRDVNIQDVYEAIGAAAAGKITDEELTELEKVACPGIGACGGQYTANTMATVIEALGIAPVGSGSTPQPHPDKKRICYEAGKLVVDQLKRGLKPSDILTRQAFLNGIAAATGTGGSTNAVLHLLAIAREAGVELTIDDFNEISENTPVITDLRPSGKYTAVDVYEAGGIELILKRLIEGGKIDGSQLTPTGRTLAEEVANVQERKPGQQVILSLDNPKSPVGGLVILKGNLAPEGAVVKIAASGRTYHKGPARVFDCEEDAMDAVINKQINPGDVVVIRYEGPKGGPGMREMLGVTSAIVGEGLGDSVALLTDGRFSGATRGLMVGHVSPEAAVGGPIAALREGDIVTIDLDNKKLEVDLPQEVITARMQEWKAPAPRYTSGVFAKYAALVSSASEGAVTKAFL

SEQ ID NO: 536 - DNA, 1701 bp, Thermobaculum terrenum
atgagcgacgcatcgactggatttgatcctaggcacaaaagcagaaccatagttgaggggcgtgagagggcaggtgccagatccatgctacgggccataggatggaccgacgaggatttccataagcccgttataggagtagcacactgctggatagagacaatgccctgtaactatggtcatagagagctcgcagaacatgtcaagcgagggattagagatgccggagctgtgcctgtagaggtaaacaccgtcgctataagcgatggtatcactatgggcactgaaggtatgaaggcctccttgataagccgtgaggtgattgccgactccatagaactggtggggcgagggcatatgtttgatgccatggtcatccttgtggcttgtgataaaacaatcccagctggagctatggccctagcgaggttggatataccgggttttcttatttatacaggtactatctatccaggcaaatacaagggtagagatgtgaacatccaggatgtttatgaggccataggtgcggcggcagctggcaagattacggatgaagaacttaccgagcttgaaaaggtagcttgcccaggtattggtgcctgtggagggcaatacactgccaatactatggctacagttatagaagccctgggtatagcccctgttgggtctggatctacccctcaacctcatccggataagaagaggatttgctacgaagcaggtaaattggtggttgatcaactcaagagaggactaaagccgagcgatatactcaccaggcaagctttccttaacggcatcgctgctgctaccggaactggagggtctaccaatgcagtactacacctgttggctatagcgcgagaggcaggagtagagttgactatagatgacttcaatgagataagtgagaatactccagttatcactgacttgaggccgtctggtaagtacacagcggtcgatgtctatgaagctggtggtatagagttgatactgaagaggcttatcgaaggcggtaagatagatggtagtcagctaacacccacaggcagaacacttgccgaggaagtcgcaaacgttcaggagaggaaacctggccagcaagttatattgagccttgataatcctaagagtccagtgggcgggctagtgatactcaagggcaatctcgcacctgaaggcgcagtggtaaagatagctgcgagtggtaggacatatcataagggcccagcgagagtattcgactgtgaagaagatgccatggatgcagtaatcaacaagcagataaatcctggagatgttgtagtgattagatatgaagggccaaaaggtggtcctgggatgagggagatgctaggtgtcactagcgcgatagtaggtgaaggccttggagattcggtagcactccttactgatggaaggtttagtggggctactcgtggactgatggtgggacacgtttctcctgaggctgcagtaggtggtcctatagctgccctacgagagggagatatagtaaccatagaccttgataataagaaactggaggtagacctacctcaagaggtgatcacggctagaatgcaggagtggaaagcacctgcccctcgttacacatctggtgtgtttgccaagtatgcggctctagtatcttcagcctccgagggtgctgtaaccaaagcctttctctag

SEQ ID NO: 537 - protein, 562 aa, Kribbella flavida
MVTNSTPDIKPRSRTVTDGLEATASRGMLRAVGMGDDDWAKPQIGVASSWNEITPCNLSLDRLAKAVKDGVHAASGYPLEFGTISVSDGISMGHVGMHYSLVSREIIADSVETVMEAERLDGSVLLAGCDKSLPGMLMAAARLDLASVFLYAGSIMPGRLGDKDVTVIDAFEAVGACVRGLITREQVDAVERAICPGEGACGGMYTANTMAASAEALGMSLPGSAAPPAVDRRRDGYARRSGEAVVGLLRNGITARQILTKEAFENAIAVVMALGGSTNAVLHLLAIAREAEVDLSLADFNRIGDKVPHLGDLKPFGQYVMTDVDRVGGIPVVMRALLDAGLLHGDCLTVTGKTMAENLADIAPPDVDGVIIRALDRPIHGTGGITILHGSLAPEGAVVKSAGFDSDVFEGTARVFDGERGAMDAIEDGTMQAGDVVVIRYEGPKGGPGMREMLAVTGAIKGAGLGKDVLLLTDGRFSGGTTGLCVGHVAPEAVDGGPIAFVRDGDRITLDVKNRTLELHVDADELERRRQGWTPKEPAITRGVLGKYTRLVRSASEGAVCI

SEQ ID NO: 538 - DNA, 1689 bp, Kribbella flavida
atggtgacgaacagcactccggacatcaagccccgcagccgtacggtgaccgacgggctcgaggcaaccgcttcgcggggcatgctccgcgccgtcgggatgggcgacgacgactgggccaagccgcagatcggcgtcgcgtcgagctggaacgagatcaccccgtgcaacctgtcgctcgaccggctcgcgaaggcggtcaaggacggcgtgcacgcggcgagcggctacccgctggagttcggcacgatcagtgtctccgacggcatctcgatgggccacgtcggcatgcactactcgctggtcagccgggagatcatcgccgactcggtggagaccgtgatggaggccgagcggctcgacggctcggtgctgctggccggctgcgacaagtccctgcccggcatgctgatggccgccgcgcgcctcgacctggccagcgtcttcctgtacgccgggtcgatcatgcccggccggctcggcgacaaggacgtcacggtgatcgacgccttcgaggcggtcggcgcctgcgtgcgcggcctgatcacccgcgagcaggtcgacgccgtcgagcgcgcgatctgccccggcgagggcgcctgcggcggcatgtacaccgcgaacacgatggccgcctcggcggaggcgctcggcatgtccctgccgggttccgcggcgccgcccgctgtcgaccggcgccgcgacggctacgcccgccggtccggcgaggccgtcgtcggcctgctgcgcaacggcatcaccgcccggcaaatcctcaccaaggaagccttcgagaacgcgatcgccgtcgtgatggcgctcggcggctccaccaacgcggtcctgcacctgctggcgatcgcccgggaggccgaggtcgacctgagcctggccgacttcaaccggatcggcgacaaggtgccgcacctgggcgacctcaagccgttcgggcagtacgtgatgaccgacgtcgaccgggtcggcggcatcccggtggtgatgcgcgcgctgctggacgccggcctgctgcacggcgactgcctgaccgtgaccggcaagacgatggccgagaacctcgccgacatcgcgccgccggacgtcgacggcgtgatcatccgggcgctggaccggccgatccacggcaccggcggcatcaccatcctgcacggctcgctggcgccggagggcgcggtggtgaagagcgccggcttcgactccgacgtgttcgagggcaccgcgcgggtcttcgacggcgagcgcggcgcgatggacgcgatcgaggacggcaccatgcaggccggcgacgtggtggtgatccgctacgagggcccgaagggcggtccgggcatgcgcgagatgctcgcggtgaccggcgcgatcaagggcgccggcctcggcaaggacgtcctgctgctcaccgacggccgcttctccggcggtacgacgggcctgtgcgtcggccacgtcgcgccggaagccgtcgacggcgggccgatcgccttcgtgcgcgacggcgaccggatcacgctggacgtgaagaaccggaccctggagctgcacgtcgacgccgacgagctggagcgccgccgccagggctggacgccgaaggagccggccatcacccgcggagtgctcggcaagtacacccggctggtgcggtcggcctcggaaggcgccgtttgcatctga

SEQ ID NO: 539 - protein, 573 aa, Gordonia bronchialis
MSPSPESSTTNDVDIKPRSRDVTDGLERTAARGMLRAVGMGDDDWAKPQIGIGSSWNEITPCNLSLDRLATSVKEGVFAAGGYPLEFGTISVSDGISMGHEGMHFSLVSREVIADSVETVMSAERLDGSVLLAGCDKSLPGMLMAAARLDLANVFLYAGSTLPGYATLSDGSERQVTIIDAFEAVGACSRGLMSRADVDTIERAICPGEGACGGMYTANTMASVAEALGMSLPGSAAPPAPDRRRDQFARRSGEAVVELLRCGITARDIMTFEAFENAIAVVMAFGGSTNAVLHLLAIAHEADVALSLADFSRIGSCVPHLADVKPFGQHVMTDVDRIGGVPVVMKALLDAGLLNGDCLTVTGKTMAENLADIAPPDPDGKVLRAMTTPIHPTGGITILTGSLAPGGAVVKSAGFDSDVFEGVARVFDRERAAMDALEDGTITAGDVVVIRYEGPKGGPGMREMLAITGAIKGAGLGKDVLLMTDGRFSGGTTGLCVGHIAPEAVDGGPIALVRDGDRIRLDVASGTLDILVDEDEMASRAKGFTPLLPRYTRGVLAKYAKLVTSASRGAICE

SEQ ID NO: 540 - DNA, 1722 bp, Gordonia bronchialis
atgagcccctcacctgagtcctcgaccaccaacgacgtggacatcaagccccgcagccgagacgtcaccgacggcctcgaacggaccgcggcacgcggcatgctccgcgcggtcggcatgggtgacgacgactgggccaaaccgcagatcgggatcgggtcgtcgtggaacgagatcaccccctgcaacctgtcgctggaccggctggccacctcggtcaaggaaggtgtcttcgccgccggtggctaccctctcgaattcggcaccatctcggtgtccgacggcatctcgatgggacacgagggtatgcatttctcgctggtctcgcgcgaggtgatcgccgacagcgtcgagacggtcatgagtgccgaacggctcgacgggtcggtgctgctcgccggttgtgacaagtcgctgcccggaatgctgatggcggccgcccggctcgatcttgcgaatgtgttcctctacgccggctcgacgctgcccggctatgccacgctgtccgacggctcggagcggcaggtcaccatcatcgacgccttcgaggcggtcggggcgtgctcgcgcgggctgatgagcagagccgacgtggataccatcgaacgcgccatctgtcccggtgagggcgcctgcggtggcatgtacacggccaacacgatggccagcgtcgccgaggcgctgggcatgtcgctgccgggtagtgcggcgccgcccgccccggaccggcgacgcgaccagttcgcgcgccgcagcggcgaggccgtcgtcgaactcctgcgttgcggcatcaccgcgcgcgacatcatgaccttcgaggcgttcgagaacgcgatcgcggtggtcatggccttcggcggatcgaccaacgccgtgctgcatctgctggccatcgcccacgaggccgacgtcgcgctcagcctggccgacttctcccgaatcggttcgtgcgtaccgcatctggccgatgtcaagccgttcggtcagcacgtgatgaccgatgtggaccggatcggtggcgtgccggtggtgatgaaggcgctgctcgacgcgggcctgctcaacggcgactgcctcaccgtcaccggcaagacgatggcggagaatctagccgacatcgcgccgccggacccggacggaaaagtgttgcgcgccatgacaacaccgatccaccccaccgggggtatcaccatcctgaccggttcgctcgcgccgggcggtgcggtggtgaagtcggccggcttcgactccgacgtcttcgaaggtgtggcgcgcgtgttcgaccgggagcgtgccgcgatggacgccctcgaggacggcaccatcaccgccggtgacgtggtggtcatcaggtacgaggggcccaagggcggtccgggtatgcgcgagatgcttgccatcaccggcgccatcaagggtgcgggtctcggcaaggacgtgctgctgatgaccgacggccggttctccggcggcaccaccggcctgtgcgtgggtcacatcgcgcccgaggccgtcgacggcgggccgatcgccctggtacgcgacggcgaccggattcgcctcgacgtggcgtcgggcacgctcgacatcctcgtcgacgaagatgagatggcttctcgggcaaagggattcaccccgcttctgccccggtacacgcggggtgtgctggcgaagtacgccaaactcgtcacctccgcatctcgcggagcgatctgcgaatga

SEQ ID NO: 541 - protein, 575 aa, Geodermatophilus obscurus
MTIGEDLIPGRDSHSGTHSPLKPRSYEVTDGIAKAPARAMLRAVGMGDDDWEKPQIGVASSWNEITPCNLSLDRLAKRAKEGVHAAGGYPLEFGTISVSDGISMGHEGMRASLVSREVIADSVETVVFAERLDGTVLLAGCDKSLPGMLMAAARLDLASVFVYSGSILPGRLGDRDNLTIIDVFEGVGACARGLISREELDAIEKAACPSEGSCGGMYTANTMASVAEALGMALPGSAAPPAPDSRRDAVAIASGEAVVNLLRQGITARQIMTREAFENAITVVMALGGSTNAVLHLLAIAHEAQVELTLEDFNRIGDRTPHLADVKPFGRFVMTDIDRVGGVPVVLRALLDAGLLHGDVLTVTGKTMAENLAEIAPPDLDGTIVHAMDNPIHKTGGLTILRGSLSPDGAVVKSAGFDADVFEGTARVFDGEQGAMDAVTEGTLQAGDVVVIRYEGPRGGPGMREMLAVTGAIKGAGLGKDVLLLTDGRFSGGTTGLCVGHVAPEATDGGPIALVQDGDRIRLDLTTRTLDLLVDDDELARRRQDWQPLPPRYTTGVLGKYAKLVSSAAQGAVCG

SEQ ID NO: 542 - DNA, 1728 bp, Geodermatophilus obscurus
gtgacgatcggcgaggacctcatccccgggcgcgactcccacagcgggacgcacagcccgctcaagccgcgcagctacgaggtgaccgacggcatcgccaaggccccggcgcgggcgatgctgcgtgcggtgggcatgggcgacgacgactgggagaagccgcagatcggcgtcgcctcgtcgtggaacgagatcaccccgtgcaacctctcgctggaccggctggccaagcgggccaaggagggcgtgcacgccgccggcggctacccgctggagttcggcaccatctccgtctccgacggcatctcgatgggccacgagggcatgcgggcctcgctggtctcccgcgaggtcatcgccgactcggtcgagacggtcgtgttcgccgagcgcctcgacggcacggtgctgctcgccggctgcgacaagtccctgcccggcatgctcatggccgcggcccgcctcgacctcgccagtgtcttcgtctactccggctcgatcctgcccggacggctcggtgaccgggacaacctgacgatcatcgacgtcttcgagggcgtcggggcctgcgcccgcgggctgatcagccgtgaggagctggacgccatcgagaaggcggcctgccccagcgagggctcctgcggcggcatgtacaccgccaacacgatggccagcgtcgccgaggcgctggggatggcgctgcccggcagcgccgcgccgccggcgccggacagccgccgcgacgccgtggcgatcgcctccggcgaggccgtggtcaacctgctgcgccaggggatcaccgcccggcagatcatgacccgggaggcgttcgagaacgccatcaccgtcgtcatggcgctggggggctcgaccaacgccgtcctgcacctgctggccatcgcgcacgaggcccaggtcgagctcacgctcgaggacttcaaccggatcggcgaccgcaccccgcacctggccgacgtcaagcccttcggccggttcgtcatgaccgacatcgaccgtgtcggcggcgtcccggtcgtgctgcgcgcgctgctcgacgccggcctgctgcacggcgacgtcctgaccgtgaccgggaagacgatggccgagaacctcgccgagatcgccccgcccgacctggacggcacgatcgtccacgccatggacaacccgatccacaagaccggcggcctgaccatcctgcgcggctcgctgtccccggacggcgcggtcgtgaagtcggccggcttcgacgccgacgtcttcgagggcaccgcgcgcgtcttcgacggcgagcagggcgccatggacgccgtcaccgagggcacgctgcaggcgggcgacgtcgtggtgatccgctacgagggtccccggggcgggccgggcatgcgcgagatgctcgccgtcaccggcgccatcaagggggcgggcctgggcaaggacgtcctgctgctcaccgacggccggttctccggcgggacgacgggcctgtgcgtcggccacgtcgcgcccgaggccaccgacggcggcccgatcgccctcgtgcaggacggcgaccgcatccggctggacctcaccacccgcaccctcgacctgctggtcgacgacgacgagctggcccgccgccggcaggactggcagccgctgcccccgcgctacaccaccggcgtcctcggcaagtacgccaagctggtgagctccgcggcccagggcgccgtctgcggctga

SEQ ID NO: 543 - protein, 570 aa, Xylanimonas cellulosilytica
MVSDDGGGRSLKPRSWQVTDGLEATAARGMLRAVGLGDEDFAKPQIGVASSWNEITPCNLSLDRLAQACKSGVHAAGGYPLEFGTISVSDGISMGHEGMHFSLVSRDVIADSVEVVMSAERLDGSVLLAGCDKSLPGMLMAAARLDLASVFLYAGSIMPGWVKLSDGTEKEVTIIDAFEAVGACARGLMSEDDVGRIERAICPGEGACGGMYTANTMASAAEALGMSLPGSAAPPSADRRRDAWALRSGEAVVGLLRAGITARDILTKEAFENAIAVVMAFGGSTNAVLHLLAIAHEADVDLTLADFDRVADRVPHLGDLKPFGRYVMNDVDRVGGVPVVMKALLDAGLLHGDALTVTGRTVAENLAAIDPPDPDGKILRAVADPIRATGGITILHGSLAPDGAVVKSAGFESDVFEGTARVFERERAALDALEDGTIVAGDVVVIRYEGPKGGPGMREMLAITGAIKGAGLGKDVLLVTDGRFSGGTTGLCVGHIAPEAVDGGPVAFVRDGDRVRLDVRAKTLDLLVEPGTLAARRAEGWAPLQHGYTRGVLAKYTKLVQSASRGAVLE

SEQ ID NO: 544 - DNA, 1713 bp, Xylanimonas cellulosilytica
atggtgtccgacgacggtggggggcgatcgctgaagccgcggtcgtggcaggtgaccgacgggttggaggcgacggcggctcgcgggatgctgcgtgccgtcgggctcggggacgaggacttcgccaaaccgcagatcggggtcgcgtcgtcgtggaacgagatcacgccctgcaacctgtcgctcgaccggctcgcgcaggcgtgcaagtcgggcgtgcacgcggccggcgggtacccgctcgagttcgggacgatttcggtgtccgacgggatctcgatggggcacgagggcatgcacttctcgctcgtgtcgcgcgacgtcatcgcggactcggtcgaggtggtgatgtcggccgagcggctcgacgggtcggtgctgctcgcgggatgcgacaagtcgctgcccgggatgctcatggccgcggcgcggctcgacctggccagcgtgttcctctacgccggctcgatcatgcccggctgggtcaagctctcggacggcaccgagaaggaagtcaccatcatcgacgccttcgaggcggtcggggcgtgcgcgcgcggcctgatgagcgaggacgacgtcgggcgcatcgagcgggccatctgccccggcgagggtgcctgcggcggcatgtacaccgccaacacgatggcctcggccgcggaggcgctcgggatgtccctgcccggctcggcggcaccgccgtcggccgaccggcgtcgcgacgcgtgggcgctgcggtcgggggaggccgtcgtcgggctgctgcgggccgggatcaccgcccgcgacatcctcacgaaggaggcgttcgagaacgccatcgccgtcgtcatggcgttcggcgggtccacgaacgcggtgctgcacctgctcgccatcgcgcacgaggccgacgtcgacctgacgctcgccgacttcgaccgggtcgcggaccgggtaccgcacctgggagacctcaagcccttcgggcggtacgtcatgaacgacgtcgaccgcgtcggcggggtgccggtcgtgatgaaagcgctgctcgacgccgggctgctgcacggggacgcgctgaccgtcaccggccgcacggtggccgagaacctcgcggcgatcgacccgcccgacccggacggcaagatcctgcgggccgtggccgacccgatccgggcgaccggtggtatcaccatcctgcacgggtcgctcgccccggacggcgccgtcgtgaagtcggccgggttcgagtccgacgtgttcgagggcacggcccgggtcttcgagcgggagcgggccgcgctcgacgcgctcgaggacggcaccatcgtggccggtgacgtcgtcgtcatccggtacgaaggaccgaagggcgggcccggcatgcgcgagatgctcgccatcaccggggcgatcaagggcgccgggctcggcaaggacgtgctgctggtcaccgatgggcggttctcgggcgggacgaccgggctgtgcgtgggacacatcgcccccgaggccgtcgacggcggcccggtcgcgttcgtgcgcgacggcgaccgggtgcggctcgacgtgcgcgccaagacgctcgacctgctcgtcgagccggggacgctcgccgcccgacgggcggagggctgggcgccgctgcagcacggctacacccgcggggtgctcgccaagtacacgaagctggtccagtcggcctcgcgcggcgcggtcctcgagtag

SEQ ID NO: 545 - protein, 566 aa, Sphingobacterium spiritivorum
MKSSSNGENQMNKYSRTFTQDETQPAAKAMLYGIGLTDADMDKAQVGIASMGYDGNTCNMHLNDLAQVVKKGVWESELVGLTFGTIGVSDGMSNGTEGMRYSLVSRDVIADSIETICGGQYYDGLIAIPGCDKNMPGAVIAMGRLNRPSIMVYGGTIAPGHYKGEELNIVSAFEALGQKICGNLSDEDYEGIIKHTCPGAGACGGMYTANTMASAIEALGMSLPYSSSNPAVSSDKKDECLQAGKYIRTLLEKDIKPSDIMTRKAFENALRAIVILGGSTNAVLHFIAIGKAVGVDITQDDFQRMSDETPVLADFKPSGKYLMQDLHQYGGTPAVLKYLLDEGLLHGDCLTVTGKTLAENLADVKSIMDYDQKIIQPLSNPIKPSGHLQILYGNLAEKGSVAKISGKEGEKFTGPARVFDGEQNLIRGIQDGTVKKGDVVVIINEGPVGAPGMPEMLKPTSAIIGAGLGKSVALITDGRFSGGTHGFVVGHITPEAYQGGLIGLVENDDIIEIDAVNNTINLKVDDATIAKRREKWVQPSLKVSKGVLYKYAKTVSDASEGCVTDQ

SEQ ID NO: 546 - DNA, 1701 bp, Sphingobacterium spiritivorum
atgaagtcatcatctaacggcgagaatcaaatgaataaatacagccgtacgtttacacaagacgaaacacaacccgcagccaaagccatgctatacggaatcggtcttaccgatgcagatatggataaggctcaggtcggtattgcaagcatgggatatgatgggaatacatgtaatatgcacctgaatgatctggcacaagtggtcaaaaaaggtgtgtgggaaagcgaattggtaggcttgacttttggaacaataggtgtgagtgacggaatgagtaatggtacagaaggtatgcgctactcgttggtaagtcgtgatgtcatagccgacagcatagaaacaatctgtggcggacagtactatgacggattgattgccatcccgggttgcgacaagaacatgccgggcgctgtcatcgctatgggtcgcctgaatcgtccttctataatggtatacggaggtacaatagcgccgggacattataaaggagaagaactgaatattgtatcggcttttgaagcattaggacaaaaaatctgtggtaacctgtccgatgaagactacgaaggaatcatcaagcatacctgtccgggagcaggagcctgcggtggcatgtacactgcaaatacaatggcatctgcgattgaggccttagggatgagcctaccttattcatcttctaatccggcagtatcttcagataaaaaagacgaatgtcttcaggcaggtaaatacattcgtacactgttggaaaaagatatcaagccgtcagatatcatgacacgtaaagcctttgaaaatgcccttagagcaattgtaattttaggcggcagcacaaatgcggtattacactttatcgcaatcggaaaagctgtaggagtcgatatcacacaggatgactttcaacgcatgagtgatgaaactcctgtactggcggatttcaaaccgtcaggaaaatatctgatgcaggatctgcatcaatatggaggtacgcctgcagtattgaaatatttactggatgaggggttattacacggagattgtctgactgttactgggaaaacattagcagagaatcttgcagacgtaaaatccatcatggactatgatcaaaagatcattcagccattgagcaatccgatcaaaccaagcggtcaccttcagattctatacggcaatctggcagaaaaaggttctgtagccaagatttcaggtaaagaaggtgagaaattcaccggtcctgcccgcgtttttgacggagagcagaacctgatccgcggaattcaggatggtactgtaaaaaaaggtgatgtagtcgttatcatcaacgaaggtcccgtaggagctccgggtatgccggaaatgttaaagcctacatccgctattatcggagcaggactcggaaaatcagtagccctgattacagacggccgcttctccggaggtacacacggatttgtagtcggacacattactccggaagcctatcagggtggtctgatcggattagtagaaaatgacgatatcattgagatcgatgcggtcaataataccatcaatctgaaagtagacgatgccacaatagccaagcgtagagaaaaatgggtacagccgtcattgaaagtatctaaaggtgttctttacaaatacgcaaaaacagtttcggatgcgtccgaaggttgtgttacagatcagtaa

SEQ ID NO: 547 - protein, 554 aa, Meiothermus silvanus
MRSDVIKQGPQQAPARAMLRAVGVTDDDFKIPWIGIVNTWTEGMPCNFHLRELAADLKVGAKEAGLHAFEFGAPAISDGISMGTIGMRASLISREVIADSIELIARGYLYDGMVALVACDKTNPGGMMGVIRADVPSLVLYGGSIAPGILRDKKQTVVSVFEAVGQYAAGKITEQELAEVERTAIPGPGACGGQYTANTMAMVLEVMGFSPIGYNAIPAIAPHKKAAGRKAMHILAEAIRENRTPKSFLTRQSFVNAIAAVAATGGSTNAVLHLLAIAREAGVKLELDDFDTISRKTPVIADMRPWGTYTAWELWEAGGIPLIIRRLIEGEMIDGSQMTITGKTLWEEVKDAAETPGQQVVVPREKAFKPEGGLRILKGSLAPEGAVLKLAGTERKQFRGPARVFDGEQKAMKAVLAKEIQPGDVVVIRYEGPKGAPGMPEMLSVTSALVGEGLGPDVALVTDGRFSGGTKGLMIGHVAPEAQVGGPIALVEEGDLISIDCDAGRLELEVSPEVLEARRAKWKAPEPHYKSGLFARYAKLVSSAKYGAVLEQAE

SEQ ID NO: 548 - DNA, 1665 bp, Meiothermus silvanus
atgcgctcggatgtgatcaaacaaggcccgcagcaagctcctgcgcgtgcgatgttgcgtgcggtgggggtaacggacgacgacttcaagattccttggataggcatcgtcaacacctggaccgaagggatgccctgcaatttccacctacgcgagttagccgccgacctcaaggtaggggctaaagaggctgggctgcatgccttcgagttcggcgccccggccatttccgacgggatcagcatgggcaccatagggatgcgggcttcgctcatcagccgcgaggtaatcgccgactccatcgaactcatcgcccggggctacctctacgacggaatggtagcgctagtagcctgcgacaagaccaaccccggcgggatgatgggggtgattcgcgccgacgtaccgagcctagtgctctatggtggctccattgcccccggtatcctgcgcgacaaaaagcagaccgtggtctcggttttcgaggcagtggggcagtacgcagcaggcaaaattactgaacaagagctggccgaggtcgaacgcaccgccatccccggccctggggcctgcggggggcagtacacggcaaataccatggccatggtgctggaggtgatgggcttctcccctatcggctacaacgctatccctgccattgccccccacaagaaagccgccggacgaaaggcgatgcacatcctggccgaggccatccgggagaaccgcacgcccaagagcttcctcacccggcagtccttcgtcaacgcgatcgccgcagtagccgccacgggcggctcgaccaacgcggtcttgcacctcctggcgatcgcccgcgaggcgggggtcaagctcgagctggacgacttcgacaccatctcccgcaagaccccggtgatcgccgacatgcgcccctggggcacctacaccgcctgggagctgtgggaagccgggggcatcccgctcatcatccgccgcctgatcgaaggggagatgatcgacggcagccagatgaccataaccggcaagaccctttgggaagaggtcaaggacgccgccgagaccccgggacagcaggtggtggtcccgcgggagaaagccttcaagcccgagggagggctacgcattctgaagggctcattggcccccgaaggggcggtcttgaagctcgccggaaccgagcgcaagcagttccgcggcccggcccgggtcttcgacggcgagcaaaaggccatgaaagcggtgctggccaaagagatccagcccggggatgtggtggtgatccgctacgagggccccaagggagcccccggaatgcccgaaatgctctcggtgacgagtgctttagtgggcgaggggctcggcccggacgtagcgttggtaaccgacggacgctttagcggcggaaccaagggcctgatgatcgggcacgtcgcgccggaagcccaggttggcggtccgattgcgctcgtcgaagagggggacctcatctcgattgactgcgacgcggggaggctcgagctggaggtctcccccgaggtgttggaagcgcgcagggctaagtggaaggcccctgagccgcattacaagagcgggctgtttgcccggtacgccaaactggtgagcagtgcgaagtatggggcagtgctcgagcaagccgagtaa

SEQ ID NO: 549 - protein, 554 aa, Meiothermus ruber
MRSDIIKKGPQQAPARAMLRAVGIGDEEFKIPWVGIVNTWTEGMPCNFHLRDLAADLKIGAREAGFQTFEFGAPAISDGISMGTVGMRASLVSREVIADSIELIAQGYLYDGMVALVACDKTNPGAMMGVIRANVPSLVLYGGSIAPGLLRGKKQTVVSVFEAVGQYAAGQITEEELAEIERTAIPGPGACGGQYTANTMAMILEVMGFSPIGYNAIPAVAPEKKEAGRRAMRILAEAIQAGRTPKSFLTKKSFTNAITAVAATGGSTNAVLHLLAIAREAGIKLTLEEFDKISRKTPVIADMRPWGQYTAWELWEAGGIPLVIRRLIEGGLIDGDQMTVSGKTLWQEVKNARETKGQQVVTSVKKPFKPEGGLRVLKGSLAPDGAVLKLAGTETKVHRGPARVFDGEQSAMKAVLKKQIKPGDVVVIRYEGPKGAPGMPEMLSVTSALVGEGLGPYVALVTDGRFSGGTKGLMIGHVAPEAQVGGPIALVEEGDIISIDCDRGILNLEVSEKELARRAKAWKPPKPHYKSGLFARYAALVSSAREGAVLLKPE

SEQ ID NO: 550 - DNA, 1665 bp, Meiothermus ruber
atgcgttcggacatcatcaaaaaaggccctcaacaagcccccgcccgggctatgctgcgcgcggtgggcatcggcgacgaagagttcaagattccctgggtgggcatcgtgaacacctggaccgaggggatgccctgcaactttcacctgcgcgacctggccgccgacctgaagattggggccagggaggctggcttccagacctttgagtttggggccccggccatctccgacggcatcagcatgggcacggtgggtatgcgggcctcgctggtgagccgcgaggtgatcgccgactcgattgaactgattgcccagggctacctctacgacggcatggtggccctggtggcctgcgacaagaccaaccctggggccatgatgggggtgatccgggccaacgtgcccagcctggtgctgtacggcggctccattgcccccggcctcctgcgcggcaaaaagcagaccgtggtctcggtctttgaggcggtggggcagtacgcggccggccagattaccgaggaagagctggccgagatcgagcgcaccgccattcccggccccggtgcttgcggcgggcagtacaccgccaacaccatggccatgatcctcgaggtgatgggcttctcgcccatcggctacaacgccatcccggccgtcgcccccgagaaaaaagaggccgggcggcgggccatgcgcatcctggccgaggccatccaggcgggccgcacccccaagagcttcctgaccaaaaagagcttcaccaatgcgattaccgcggtggcggccaccggcggctcgaccaatgcggtgctgcacctgctggccatcgccagggaggccgggattaaactgacgctcgaggagttcgataaaatctcgcgtaaaaccccggtgattgccgatatgcgcccctggggtcagtacaccgcctgggagctctgggaggctgggggcatcccgctggtgattcgccgcctgattgaaggcggcctgattgacggcgaccagatgaccgtgagcgggaaaaccctctggcaggaggttaaaaacgccagagagaccaagggccagcaggtggttaccagcgtcaaaaaacccttcaaacccgaagggggcctgcgggtgctcaagggttcgctggccccggacggcgcggtgctcaagctggccggcaccgagaccaaggtacaccgggggccggcccgggttttcgacggcgaacagagcgccatgaaggccgtcctcaaaaaacagatcaagcccggtgatgtggtggtgatccgctacgaaggccccaagggggcccccgggatgcccgagatgctctcggtgacctcggccctggtgggcgagggactggggccgtatgtggccctggtgaccgatgggcgtttcagcggtggcaccaagggcctgatgatcgggcatgtggcccctgaggcccaggtgggcgggcccatcgcgctggtcgaggagggcgacatcatctcgattgactgcgaccggggtatcctgaacctggaggtctcggaaaaggagctggcccggcgggccaaagcctggaagccccccaagccccactacaaaagcgggctgtttgcgcgctacgcagcgctggtgagcagtgcacgggagggggcggtcttattgaagcccgagtaa

SEQ ID NO: 551 - protein, 567 aa, Nakamurella multipartita
MSETAADAAGKQHRKPHSHIVTDGIERAPARGMLRAVGMGDDDWRKPQIGVASSWNEITPCNMSLDRLAKAAKQGVHEADGYPLEFGTISVSDGISMGHGGMHYSLVSREVIADSVETVFRAEQLDGGVLLAGCDKSEPGMLMAAARLDIAAVFLYAGSTLPGQLDGETVTIIDAFEGVGACLAGKISRERLTEIEKAICPGEGACGGMYTANTMASVAEALGMSLPGSAAPPAPDARRDTYAIRSGQAVVALIDAGITSRDILTKKAFENAITVLMALGGSTNAVLHLMAIAHEAKVDLALEDFNRIGERTPHLADVKPFGRYVMTDVDRIGGVPVVMKALLDAGLLHGDTLTVTGKTMAENLAELNPPELDGDVLRKLSNPIHTTGGITILHGSLAPEGAVIKSAGIEYAEFTGPARVFDGEAGVLEAVTNGTLGKGDVIVIRWEGPKGGPGMREMLAVTGAIKGAGLGKDVLLLTDGRFSGGTTGPCIGHIAPEAAHGGPIALVQEGDQIRLDLAAKTLDLLVDEAELERRRADWEPREQNLNFGVAGKYAKLVGSAAKGAVCF

SEQ ID NO: 552 - DNA, 1704 bp, Nakamurella multipartita
atgagcgagaccgccgccgacgccgcaggaaagcagcaccgcaagccgcacagccacatcgtcaccgacggcatcgagcgggctccggcccgcggcatgctgcgggcggtgggcatgggcgacgacgactggcgcaagccgcagatcggcgtcgccagttcctggaacgagatcaccccgtgcaacatgtccctggaccggctggccaaggcggccaagcagggcgtgcacgaggccgacggctacccgctggagttcggcaccatctcggtgtccgacggcatctccatgggccacggcggcatgcactactcgctggtcagccgtgaggtcatcgccgactcggtggagacggtcttccgggccgagcagctcgacggcggggtgctgctggccggctgcgacaagtccgagcccggcatgctgatggccgcggcccgcctggacatcgcggccgtgttcctctacgccggctcgaccctgcccggtcagctcgacggcgagaccgtcaccatcatcgacgccttcgaaggcgtcggcgcctgcctggccggcaagatcagccgggagcggctgaccgagatcgagaaggccatctgtccgggcgagggcgcctgcggcggcatgtacacggccaacacgatggccagcgtggccgaggcgctgggcatgtcgctgcccggcagcgccgcgccgcccgccccggacgcgcgccgggacacctacgcgatccgcagcgggcaggccgtcgtcgccctcatcgacgccggcatcacctcgcgcgacatcctgaccaagaaggcgttcgagaacgcgatcacggtgctgatggcgctgggcgggtcgacgaacgcggtgctgcacctgatggccatcgcgcacgaggccaaggtcgacctggccctggaggacttcaaccggatcggcgagcggaccccgcacctggccgatgtcaagccgttcggccgctacgtgatgaccgacgtggaccgcatcggcggggtgccggtggtgatgaaggcgctgctggacgcgggcctgctgcacggggacacgctgaccgtcaccggcaagacgatggccgagaacctggccgagctgaacccgccggagctggacggcgacgtgctgcgcaagctgtccaatccgatccacaccaccggcgggatcaccatcctgcacggctcgctggccccggagggcgcggtgatcaagagcgccgggatcgagtacgccgagttcaccggcccggcccgggtgttcgacggcgaggccggggtgctcgaggcggtcaccaacggcacgctgggcaagggcgacgtcatcgtcatccgctgggagggccccaagggcggcccggggatgcgcgagatgctcgccgtcaccggcgcgatcaagggtgccggcctgggcaaggacgtcctgctgctcaccgacggccggttctccggcggcaccaccggcccctgcatcgggcacatcgccccggaggcagcgcacggcgggccgatcgcgctggtgcaggagggtgatcagatccggctcgacctggccgccaagaccctggacctgctggtcgacgaggccgagctggagcgacgccgggccgattgggagccccgcgagcagaacctgaacttcggggtcgccggcaagtacgccaagctggtcggctcggccgccaagggcgccgtctgcttctga

SEQ ID NO: 553 - protein, 570 aa, Cellulomonas flavigena
MTSAGGDDGVDIKPRSRQVTDGLEATAARGMLRAVGLGDEDFAKPQVGVASSWNEITPCNLSLDRLAKAVKGGVHAAGGYPLEFGTISVSDGISMGHEGMHFSLVSRDIIADSVETVMMAERLDGSVLLAGCDKSLPGMLMAAARLDLASVFLYAGSIMPGWVKLSDGTEKDVTIIDAFEAVGACARGLMSREDVDRIERAICPGEGACGGMYTANTMASVAEAMGMSLPGSAAPPSADRRRDQFAHRSGEAVVELLRRGITARRIMTKEAFENAIAVVMAFGGSTNAVLHLLAIAHEAEVDLTLEDFSRVAAKVPHLGDLKPFGRYVMNDVDRVGGVPVVMKALLDAGLLHGDCLTVTGRTVAENLAEIAPPDPDGKILRALDDPIHRTGGITILSGSLAPEGAVVKSAGFDSDVFEGTARVFERERAALDALEDGTIRAGDVVVIRYEGPKGGPGMREMLAITGAIKGAGLGKDVLLVTDGRFSGGTTGLCVGHIAPEAVDAGPIAFVRDGDRVRLDVAHATLDLLVDDAELVARREGWAPLAPRYTRGVLGKYQKLVQSASRGAVLG

SEQ ID NO: 554 - DNA, 1713 bp, Cellulomonas flavigena
atgacgagcgcaggcggggacgacggcgtggacatcaagccgcggtcgcggcaggtgaccgacgggctggaggcgacggcggcgcgcggcatgctgcgcgcggtcgggctgggggacgaggacttcgcgaagccgcaggtgggcgtcgcgtcgtcgtggaacgagatcacgccgtgcaacctgtcgctcgaccggctcgccaaggccgtgaagggcggggtgcacgcggccggggggtacccgctggagttcggcacgatctcggtgtccgacggcatctcgatgggccacgagggcatgcacttctcgctcgtgagccgggacatcatcgcggactccgtggagacggtgatgatggccgagcgcctcgacggctcggtcctcctggccgggtgcgacaagtccttgccgggcatgctcatggctgcggcgcgcctcgacctcgcgagcgtgttcctctacgcgggctcgatcatgccgggctgggtcaagctgtccgacggcaccgagaaggacgtgacgatcatcgacgcgttcgaggccgtcggggcgtgcgcccgcgggctgatgagccgcgaggacgtcgaccgcatcgagcgcgccatctgccccggcgagggtgcgtgcggcggcatgtacacggccaacaccatggcgtcggtggccgaggcgatgggcatgtcgctgcccggctcggccgcgccgccgtcggccgaccggcggcgcgaccagttcgcgcaccgctcgggcgaggcggtggtcgagctgctgcgccgtggcatcacggcccgccggatcatgaccaaggaagcgttcgagaacgcgatcgccgtcgtcatggccttcggcggatcgaccaacgccgtgctgcacctgctggccatcgcgcacgaggccgaggtggacctcacgctcgaggacttcagccgcgtcgccgcgaaggttccgcacctgggcgacctcaagccgttcggccggtacgtgatgaacgacgtcgaccgggtcggcggcgtgcccgtcgtcatgaaggccctgctcgacgcggggctgctgcacggggactgcctcacggtcacggggcgcacggtcgccgagaacctcgccgagatcgcgccgcccgacccggacggcaagatcctgcgggcgctcgacgacccgatccaccgcacgggcggcatcacgatcctgtcggggtcgctcgcgcccgagggtgcggtggtcaagtccgcgggcttcgactccgacgtgttcgagggcaccgcgcgcgtcttcgagcgtgagcgagccgcgctcgacgcgctcgaggacggcacgatccgggcgggcgacgtcgtcgtcatccggtacgagggccccaagggtggaccgggcatgcgcgagatgctcgccatcaccggggccatcaagggtgcggggctcggcaaggacgtgctcctcgtgaccgacgggcggttctcgggcggcacgacggggctctgcgtcggccacatcgcgcccgaggccgtcgacgccgggccgatcgcgttcgtccgggacggcgaccgggtgcggctcgacgtcgcgcacgccacgctcgacctgctcgtcgacgacgcggagctcgtggcccgccgggagggctgggcgccgctcgcgccgcggtacacccgtggggtgctgggcaagtaccagaagctcgtgcagtccgcgtcacgcggcgcggtgctcgggtaa

SEQ ID NO: 555 - protein, 571 aa, Rhodothermus marinus
MPPLNRYSRRITQPKSQGASQAMLLATGLKEEDLDKPQIGIASVWYEGNPCNMHLLDLAAEVKAGVQEAGMVGFRFNTIGVSDGISMGTEGMSYSLPSRDLIADSIETVMAAQWYDGLIALPGCDKNMPGCVIAMGRLNRPALMIYGGTIRPGCLNGQKLDVVSAFQSYGEYLAGKITDEQRRAIIRHACPGPGACGGMYTANTMAAAIEAMGLSLPFSSSLPAEDPRKREECRRAGHVMRRLLEQDLKPRDIVTRASLENAIAVVMALGGSTNAVLHLLAIAHAFDLPLSLDDFQRIARRVPLLADMKPSGRYVMEDLCRIGGVPAVMKLLLKHGVLHGDALTVTGKTLAENLADVPDLPENQDIIRPWDNPIKSSAHIYILYGNLAPGGCVAKITGKEGLRFSGPARVFDSEEDMLAGLEAGRIQRGDVIVIRYEGPKGGPGMPEMLTPTSALMGAGLGKDVALITDGRFSGGSHGFIIGHVVPEAQEGGPIALVRDGDRITIDAEAGLIHVDVSDEELARRRAAWTPPPLKVTRGALFRYVQTVQDASRGCITDAPIGEPQPVGSPTS

SEQ ID NO: 556 - DNA, 1716 bp, Rhodothermus marinus
atgccgccgctcaaccgctacagccgtcgcatcacccagccgaaatctcagggggcgtcgcaggccatgctgctggccaccggcctgaaggaagaagacctggacaagccccagatcggtatcgcctcggtctggtacgaaggcaacccctgcaacatgcacctgctggacctggccgccgaggtgaaggccggcgtgcaggaagccggcatggtgggcttccggttcaacacgatcggcgtctccgacggtatctcgatgggcaccgagggcatgtcctacagcctgccctcgcgcgatctgatcgcggactccatcgagacggtcatggccgcccagtggtacgacggcctcatcgcgctgcccggttgcgacaagaacatgccgggctgcgtgatcgccatgggccggctgaaccgccccgcgctgatgatctacggcggcacgatccgccccggctgcctcaacggccagaagctggacgtggtcagcgccttccagagctacggcgagtacctggcgggcaaaatcaccgacgaacagcggcgggcgatcatccgccacgcctgtccgggaccgggcgcctgcggcggcatgtacacggccaacacgatggcggcggccatcgaggccatgggcctctcgctgcccttcagctcgagcctcccggccgaagacccgcgcaaacgcgaagagtgccgccgggctggacacgtcatgcgccggcttctggagcaggacctcaaaccccgcgacatcgtcacgcgcgcctcgctcgaaaacgccatcgccgtcgtcatggcgctgggcggctcgacgaacgccgtgctgcacctgctggccatcgcgcacgccttcgacctgccgctgtcgctcgacgactttcagcgcatcgcccggcgcgtgccgctcctggccgacatgaagcccagcggccgctacgtcatggaagacctgtgtcgcatcggcggcgtgccggccgtcatgaagctgctgctcaagcacggcgtgctgcacggcgacgcgctcaccgtgacgggcaaaacgctcgccgaaaaccttgccgatgtgcccgacctgcccgagaatcaggacatcatccgcccctgggacaacccgatcaaatcaagcgcccacatctacatcctctacggcaacctggcacccggcggctgcgtggccaagatcacgggcaaagaaggactgcgtttcagcggacccgcccgcgttttcgactccgaagaagacatgctggccggactcgaagcgggccgcattcagcgcggcgacgtgatcgtcatccgctatgaaggaccgaaaggcggtccgggcatgcccgaaatgctcacgcccacctcggcgctgatgggggccggattgggcaaagacgtggcgctgatcaccgacggccgcttcagcggcggaagccacggcttcatcatcggccacgtcgtacccgaagcccaggagggcggccccatcgcgctcgtgcgcgacggcgacaggattacgatcgacgccgaagccggcctcattcacgtggacgtgtccgacgaagagctggcccgtcggcgtgccgcctggaccccgcccccgctcaaggtcacccgcggcgccctcttccgctacgtgcagaccgtgcaggacgcctcgcgcggctgcatcaccgacgccccgatcggcgaaccccaacccgtgggatctcccacttcctga

SEQ ID NO: 557 - protein, 557 aa, Planctomyces limnophilus
MLNKYSSRITQPRSQGASQAMLYATGMSREDMDKAQVGISSVWYDGNPCNMHLNKLADKVKEGVVAAGLVGMRFNTIGVSDGISMGTNGMSFSLQSRDLIADSIETVMSAQWYDANISLPGCDKNMPGCIMAMARLNRPSLMVYGGTIRAGCTPRHPKLDIVSAFQVYGEYLAGKLSDEERQEVIEHACPGAGACGGMYTANTMASAIEALGMSLPYSSSIPAEDPLKMGECLAAGKAIRTLLEKDIKPSDIMTRAAFENAMVTIMATGGSTNAVLHLIAMARAIGVSLTIDDFQKVSDRVPFIADLKPSGKYVMEDLHNVGGTPAVLKYLLEKGLLDGSCLTVTGKTLAENLEPLPGLAEGQRVIVPIETPIKETGHIRIMRGNFCPDGAVAKITGKEGLVFKGPARCYDQEEAMLKGLENNEIQKGDVIIIRYEGPKGGPGLPEMLTPTSAIMGAGLGSDVALLTDGRFSGGSHGFIVGHVTPEAQEGGPIALVKNGDIITIDAEKNSIDVDWTEADYQARKAAFVAPPYLATRGTLYKYIKNVKNASEGCVTDE

SEQ ID NO: 558 - DNA, 1674 bp, Planctomyces limnophilus
atgctcaacaagtactcgtcacgaatcacccagccacgctcgcaaggtgcctctcaagccatgctctacgccacaggcatgagccgcgaagatatggataaagcccaggttggcatttcgagtgtgtggtacgatggcaacccgtgcaacatgcacctcaataagctggccgacaaggtgaaagagggcgtcgtagccgccggcctcgtgggcatgagattcaacaccattggcgtttccgatggcatctcgatgggcaccaatgggatgtcgttctcgctgcagtcgcgcgatctgattgccgacagcatcgaaacggtcatgtcggcccagtggtacgacgccaacatttcgcttcccggttgcgataaaaacatgcctggctgcatcatggccatggctcgactcaaccgcccatcactcatggtttacggcggcaccatccgggcaggttgtactccgcgacatcccaagctcgatattgtctcggccttccaggtttatggcgaatacctcgctggtaagctgagcgacgaagagcggcaggaagtcatcgaacatgcctgtcccggtgccggtgcctgcggcggcatgtacaccgcgaatacgatggccagtgcgatcgaagctttgggaatgtcattaccctacagttcatcgatcccggcggaagatcctctcaaaatgggagaatgcctcgccgcaggcaaggctattcgcactttgctcgaaaaggatatcaagccctcagatatcatgacgcgagccgccttcgagaatgccatggtgaccatcatggccaccgggggttcaacgaacgccgtcctccacttgattgccatggctcgcgcgattggcgtctcgctcaccatcgacgacttccagaaggtttcagatcgcgtgcccttcatcgctgatctcaaaccgagtggtaaatacgtcatggaagacctgcacaacgtgggcggaactcccgcggtcctcaaatatctgctcgaaaaaggcttgctggatggcagttgcctgacggtgactggcaagaccttggccgaaaacctggagccactccccggtctggcggaaggccagcgcgtgattgtgccaattgagacacccatcaaagagactggccacatccgcattatgcgcggcaacttctgcccggacggggctgtcgccaagatcactggtaaagaagggctcgtcttcaaaggccccgctcgctgctacgatcaggaagaagcgatgctcaaggggctggaaaacaacgagattcagaagggtgatgtgatcatcatccgctacgaagggccgaagggcgggccaggtcttcccgaaatgctcaccccgacctccgccattatgggagccggtttagggagtgatgtcgcactgctgaccgacggccgcttcagtggtggatcacacggattcatcgtcggccacgtgacacccgaagcccaggaagggggcccgatcgccctcgtgaaaaacggcgacatcattaccatcgacgccgagaaaaacagcatcgacgtcgattggacagaagccgactaccaggcccgcaaagccgccttcgtcgccccaccctacctcgccacccgcggcacattatataagtatattaagaacgtgaaaaacgcgagcgaaggctgcgtgacagatgagtag

SEQ ID NO: 559 - protein, 569 aa, Beutenbergia cavernae
MTATPDTAPDIKPRSRQVTDGLEATAARGMLRAVGLGDEDFAKPQIGVASSWNEITPCNLSLDRLADAVKSGVHAAGGYPLEFGTISVSDGISMGHEGMHFSLVSREVIADSVETVMQAERLDGSVLLAGCDKSLPGMLMAAARLDLASVFLYAGSIMPGWVKLSDGTEKDVTIIDAFEAVGACARGLMSREDVDRIERAICPGEGACGGMYTANTMASVAEAMGMSIPGSAAPPSADRRRDAFAHRSGEAVVEMLRQGITARQVMTKEAFENAIAVVMAFGGSTNAVLHLLAIAYEAEVDLTLGDFQRVAARVPHLGDLKPFGRYVMNDVDRIGGVPVVMKALLDAGLLHGDCLTVTGRTVAENLEAIAPPDPDGKILRALDNPIHRTGGISILHGTLAPEGAVVKSAGFDSDVFEGTARVFDRERAAMDALEDGTITDGDVVVIRYEGPKGGPGMREMLAITGAIKGAGLGKTVLLLTDGRFSGGTTGLCVGHVAPEAVDAGPIAFVRDGDPIRLDVANATLDLLVAPAELEARRAGWEPLPPRYTRGVLAKYAKLVGSASTGAVLE

SEQ ID NO: 560 - DNA, 1710 bp, Beutenbergia cavernae
atgactgcgacccccgacaccgctccggacatcaagccccgctcgcgccaggtcaccgacggcctggaggcgaccgcagcacgggggatgctccgcgccgtcggcctcggcgacgaggacttcgcgaagccgcagatcggcgtcgcgagctcgtggaacgagatcacgccgtgcaacctgtcgctcgaccggctcgccgacgccgtcaagagcggtgtgcacgcggccggcggctacccgctcgagttcggcacgatctccgtgtcggacggcatctcgatgggccacgaggggatgcacttctcgctggtgtcgcgcgaggtgatcgccgactccgtggagaccgtcatgcaggcggagcgactggacggctccgtgctgctcgccgggtgcgacaagtccctccccgggatgctcatggcggccgcgcggctcgacctcgcgagcgtgttcctgtacgccggctcgatcatgcccggctgggtgaagctctcggacggcaccgagaaggacgtgacgatcatcgacgcgttcgaggccgtcggggcgtgcgcgcgcgggctcatgagccgcgaggacgtcgaccgcatcgagcgggccatctgccccggcgagggcgcgtgcggcgggatgtacacggcgaacaccatggcgtcggtggccgaggcgatgggcatgtcgatcccgggatcggcggcgccgccgtcggccgaccgtcgccgcgacgcgttcgcgcaccgcagcggtgaggcggtcgtcgagatgctccggcaggggatcaccgcacggcaggtcatgacgaaggaggcgttcgagaacgcgatcgccgtcgtcatggcgttcgggggctccacgaacgccgtcctccacctgctcgcgatcgcctacgaggccgaggtggacctgacgctcggcgacttccagcgcgtcgcggcgcgggtcccgcacctcggcgatctcaagccgttcggccggtacgtgatgaacgacgtcgaccgtatcgggggcgtcccggtcgtcatgaaggcgctgctcgacgccgggctcctgcacggggactgcctgaccgtcacggggcggaccgtcgcggagaacctcgaggccatcgcgccccctgacccggacggaaagatcctgcgtgcgctggacaaccccatccatcgcaccggcggcatcagcatcctgcacggcaccctcgcgcccgaaggcgccgtcgtgaagtccgcggggttcgactcggacgtgttcgagggcacggcgcgcgtgttcgaccgggagcgggccgccatggacgcgctcgaggacggcacgatcaccgacggcgacgtcgtcgtcatccggtacgaggggccgaagggcggccctgggatgcgcgagatgctcgcgatcacgggcgccatcaagggcgccggcctgggcaagacggtgctgctgctcaccgacggccggttctcgggcggcacgacggggttgtgtgtcgggcacgtcgcaccggaggccgtcgacgccgggccgatcgcgttcgtgcgtgacggcgacccgatccggctcgacgtcgcgaacgccacgctggacctcctcgtcgccccggcggagctcgaggcccgccgcgccggctgggagccgctcccgcccaggtacacccggggggtgctggcgaaatacgccaagctcgtcgggtcggcgtcgacgggtgcggtgctggagtga

SEQ ID NO: 561 - protein, 566 aa, Spirosoma linguale
MITDQSTTELNRFSRTLTQEISNPAAKAMLYGVGLSEADMQKPQIGIASTGYEGNTCNMHLNGLSVYVKQGIQASGLVGLIFNTIGVSDGMTNGNDGMRYSLPSRDLIADSIESVVAAQWYDGVVTVVGCDKNMPGAVMAMARLDRPGIMVYGGTIRSGHYKGQKLDIVSAFEALGKKYAGNISDEDYEGVIKNSIPGAGACGGMYTANTMASSIEAMGLSLPFSSSYPATHEGKQEECKKIGAAMRVLLERNITPADIITRKSLENALTIVMALGGSTNAVLHYLAIARAAGIELTLDEIQAISDRVPFLADLKPSGKYYMEDMLAIGGVPAVMKYLYQNGMLHGDCITVTGKTVAENLADAPDLNFETQQIVRPLSNPIKPTGHIQIMRGNLSPTGSVAKITGKEGLRFDGTAKVCEHEGEVIDALQKGEILPGQVIVIRNAGPKGGPGMSEMLKPTSAIMGAGLGDKVALITDGRFSGGTHGFVVGHVTPEAFDGGPIALVHDGDRITIDATTRQLILHISDEEMAQRKSEWKQPAPRFTKGTLGKYIRNVKSASEGCVTDEA

SEQ ID NO: 562 - DNA, 1701 bp, Spirosoma linguale
atgattaccgatcagtcaactaccgaattaaatcgctttagtcgcacgctcacacaggaaatatcgaatcccgcagccaaagctatgctgtatggagtcggcttgagtgaggccgatatgcaaaaaccccaaattggtattgccagcacgggttatgaaggcaatacctgtaacatgcacctaaacggtctatctgtttatgtgaagcaaggcattcaggcaagcggattggtcggattgatctttaacaccataggcgtatcagatggcatgaccaatggcaacgatggtatgcgctactcgcttcccagccgggatttgattgctgattccattgaatcggtagtagcagctcaatggtacgatggtgttgtaaccgtggttggctgtgacaaaaacatgccgggtgccgttatggccatggcgcgtctcgaccggcccggtattatggtatatggcggcaccatccggtcgggtcattataaaggacagaaattagacatcgtttcggcgtttgaagcgctgggtaaaaaatacgcgggcaacatttcggacgaagattacgagggcgtaatcaaaaactcgattccgggtgccggtgcctgtggcggtatgtatacggccaataccatggccagcagcattgaagcgatggggttaagcttgcccttcagcagcagctacccggccacccacgaaggtaaacaggaagagtgcaaaaaaattggtgcagccatgcgcgtgttgctcgaacgcaacatcacccctgccgacatcattacccgtaaatcgctcgaaaacgcactcacgattgttatggcattgggcggctctaccaatgcggtactgcattacctggccattgcccgggcagccggtattgagctaaccctcgacgaaattcaggcgatcagcgaccgggttccgttcctggccgatctgaagccaagtggtaaatactatatggaagatatgctcgccattgggggtgtaccagccgtaatgaagtacctctaccaaaacggcatgctgcacggcgactgtataaccgtaaccggtaaaaccgtagctgaaaacctcgccgacgcgcctgatctgaatttcgagacacagcagattgtacggccgctgagcaatccgatcaaaccaaccggccacattcaaatcatgcgcggcaacttgtcgccaaccggctcagttgccaagattacgggtaaagaaggtctacgtttcgacggtactgcaaaagtatgtgagcacgaaggcgaagtaatcgacgccctgcagaaaggtgaaatcttacccggtcaggttatcgttattcggaacgccgggccaaaaggtggtcccggtatgagcgagatgctgaaaccaacctcggccatcatgggcgcgggtctaggcgacaaagtagcgctgatcaccgatggacgcttttcgggtggtacccacggctttgtcgtgggacacgttacgcccgaggctttcgacggtggaccaatcgcgctggtacatgacggcgaccgcattaccatcgacgccactacccgccagctgattctgcacatttcggacgaagagatggcgcagcgtaaaagcgaatggaagcaaccggctccccgcttcacaaaagggacgctgggtaagtacatccgcaatgtaaaatcggcgagcgaaggctgcgtaacggacgaagcctaa

SEQ ID NO: 563 - protein, 565 aa, Sphaerobacter thermophilus
MVETPTAVDLRHKSRTIVEGRDRAGARAMLRATGLTDEDFRKPVIGVAHSWIETMPCNLGLRRLAQHVKRGIRDAGGVPMEVNTVAISDGVTMGTQGMKASLISREVIADSIELVGRGHMFDAIVILAACDKTLPGSAMALIRLDIPGFILYGGTIAPGHFQGRDVTIQDVYEAIGANAAGKMSDADLLELERVACPGEGACGGQYTANTMAMAIEALGLSPVGFGSWPQADPGKNEIAYQAGRLVVEQLERGLKPSDILTREAFLNGIALAAGTGGSTNIVLHFLAMAREAGIPLSIDDFNPVSERTPVIADLKPSGKYTAVDVHRAGGTQLIIKRLIEGGYMDGSQLTPSGRTLAEEVADATETPGQQVILTPETAKQPTGGLVILKGNLAPEGAVIKVAGTERTRHEGPARVFDCEEDAMAAVTSQQIRPGDVVVIRYEGPRGGPGMREMLGVTAALVGEGLGESVALLTDGRFSGATRGFMVGHVAPEAAVGGPIAALRDGDIITIDIAARTLDVTLTDEEIAARMAEWTPPPPPSGTGVFAKYAALVSSASEGAIMQPRW

SEQ ID NO: 564 - DNA, 1698 bp, Sphaerobacter thermophilus
atggtcgagacgccgactgccgtcgacctgcggcacaagagccgcacgatcgttgaagggcgcgaccgtgccggagcgcgcgccatgctgcgggccaccggtctgaccgacgaggacttccgcaagccggtcatcggcgtggcgcactcctggatcgagacgatgccctgcaacctcgggttgcggcgcctggcgcagcacgtcaagcgcggtatccgcgacgcgggcggggtgccgatggaggtcaacaccgtcgcgatcagcgacggcgtgacgatgggtacccaggggatgaaggcctcgctgatcagccgcgaggtgatcgccgactcgatcgagctggtcggccgggggcacatgttcgatgccatcgtcatcctggcggcctgcgacaagaccctgcccggctcggccatggcactgatccggctcgatatcccgggcttcatcctctacggcggcacgatcgcccccggacacttccagggccgcgacgtaacgatccaggacgtctacgaggcgatcggcgccaacgcggccgggaagatgagcgacgccgacctgctcgagctggagcgggtcgcctgcccgggcgagggcgcctgcggcgggcagtacaccgccaacacgatggccatggcgatcgaggcgctggggctctccccggtcggattcggctcctggccgcaggccgacccgggcaagaacgagatcgcctaccaggcggggcgcctggtggtcgagcaactcgagcgaggtctgaagcccagcgatatcctgacccgcgaggccttcctcaacggcatcgccctggcggccggcaccggcgggtcgaccaacatcgtgctccacttcctggccatggcgcgcgaggccggcatcccgctcagcatcgacgacttcaacccggtgagcgagcggacgccggtcatcgccgacctcaagccctccggcaagtacacggcggtcgatgtgcaccgggcgggcggcacgcagctcatcatcaagcgcctaatcgagggcggctacatggacggcagccagctcacgccgagcgggcgcacactggccgaggaagtggcggacgcgaccgagacgcccggccagcaggtgatcctgacgccggaaaccgccaagcagcccaccggcgggctggtgatcctgaaggggaaccttgcgcccgagggtgcggtgatcaaggtagccggaaccgagcgcacccggcacgagggaccggcgcgcgtcttcgactgcgaagaggacgcgatggcggccgtcaccagccagcagatccgaccgggcgacgtggtggtcattcgctacgaggggccgcgcggcgggccgggcatgcgcgagatgctcggcgtgaccgcggcgctcgtaggtgaggggctgggcgagtcggtcgcgctgctgaccgacggacgcttcagcggtgccacgcgcggcttcatggtcggccacgtcgccccagaagcggcggtcggcgggcccatcgccgcgcttcgagacggagatatcatcaccatcgacatcgcggcgcgcacgctcgacgtcacgctgaccgacgaggagatcgctgctcgcatggccgagtggacgccacccccgccgccgtcggggaccggcgttttcgccaaatacgccgcgctcgtctcctcagcctccgagggcgcgatcatgcagccgcgctggtga

SEQ ID NO: 565 - protein, 570 aa, Lactococcus lactis
MEFKYNGKVESVELNKYSKTLTPRSTQPATQAMYYGIGFKDEDFKKAQVGIVSMDWDGNPCNMHLGTLGSKIKSSVNQTDGLIGLQFHTIGVSDGIANGKLGMRYSLVSREVIADSIETNAGAEYYDAIVAIPGCDKNMPGSIIGMARLNRPSIMVYGGTIEHGEYKGEKLNIVSAFEALGQKITGNISDEDYHGVICNAIPGQGACGGMYTANTLAAAIETLGMSLPYSSSNPAVSQEKQEECDDIGLAIKNLLEKDIKPSDIMTKEAFENAITIVMVLGGSTNAVLHIIAMANAIGVEITQDDFQRISDIIPVLGDFKPSGKYMMEDLHKIGGLPAVLKYLLKEGKLHGDCLTVTGKTLAENVETALDLDFDSQDIMRPLKNPIKATGHLQILYGNLAQGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVSNEEIAKRRANYQKPTPKATRGVLAKFAKLTRPASEGCVTDL

SEQ ID NO: 566 - DNA, 1713 bp, Lactococcus lactis
atggaattcaaatataacggaaaagttgaatcagtggaactcaataaatattctaagacattgactccaagatcaacacaaccagcgactcaagcgatgtactacggcattggttttaaagatgaggatttcaaaaaagctcaggtcggaatcgtcagcatggattgggacggaaatccatgtaatatgcacttgggaacacttgggagtaaaatcaaaagttctgtcaaccaaactgacggattgattggacttcaatttcatactattggagtttctgatggaattgctaacggaaagcttggcatgagatattctttggtcagtcgtgaagttattgctgacagcatcgaaaccaacgctggcgcagaatattatgatgccatcgttgccattcccggttgtgataaaaatatgcccgggtcaattatcggaatggctcgcttaaatcgtccgtcaattatggtctatggtggaacgattgaacatggcgaatataaaggtgaaaaattaaatattgtttcggcctttgaagctctggggcaaaaaatcactggaaatatttctgatgaagattatcatggcgttatttgcaatgccattccaggacaaggtgcttgcggaggaatgtacactgccaataccctggctgctgctattgaaactttgggaatgagtttaccttattcctcttccaatccagcagtcagtcaagaaaaacaagaagagtgtgatgacattggtttagccatcaaaaatttattagaaaaagatattaaaccaagtgatatcatgaccaaagaagcttttgaaaatgccataacaattgtcatggtccttggaggctcaaccaatgctgtgcttcatatcattgcaatggcaaatgccattggtgtagaaattacgcaagatgatttccaacgtatttcagatattatccctgttcttggcgatttcaaaccgagcggaaaatatatgatggaagatctgcacaaaattggtggccttcctgctgttttgaaatacctacttaaagaaggaaaacttcacggtgattgtttgaccgtcacaggtaaaactttggctgaaaatgttgaaacagcattagatttggactttgacagtcaagatattatgcgaccactaaaaaatccaattaaagctactggacatttacaaattttgtacggtaatcttgcccaagggggttctgttgcaaaaatttctggtaaagaaggcgaatttttcaaaggaacagctcgtgtttttgacggagaacaacactttatcgatggcattgagtctggccgattgcatgccggtgatgttgcggtcattagaaatattggcccagtcggaggtccgggaatgccagagatgttaaaaccaacctcagcattaattggagcaggacttggaaaatcttgtgccctaattactgacggaagattttctggtggcacacacggctttgttgtgggtcatatcgtccctgaagcagttgaaggtgggttgattggtttagttgaagatgatgatattatcgaaattgatgcggtgaataatagtattagtttaaaagtttctaatgaagaaattgctaaacgacgtgccaattatcaaaaaccaacccctaaagcaacgcgtggtgttcttgcaaaatttgccaaacttacgcgccccgctagtgaaggttgcgttacagatttatag

SEQ ID NO: 567 - protein, 555 aa, Thermus thermophilus
MRSDQIKKGLKQAPARAMLRAVGVGDEDFGRPFVGVVNTFTDGMPCNFHLRELAQHLKAGLKEAGLFPFEFGAPAISDGISMGTPGMRASLVSREVIADSVELIAQGYLYDGMVGLSACDKTIPGTAMGVIRSGVPGMILYGGTIAPGEWQGRKLTIVEVFEAVGQRAAGKISEEELLEIERRAIPGPGACGGQYTANTMAMALEALGLSPVGYNAIPAVHPEKERATKEAGKILAWAIAHDWKPKDFLTRKSFLNAIAAVAATGGSTNAVLHLLALAKEAGVELSLDDFDQISRKTPVIADLRPWGTYTAWELYEAGGTALVFKRLLEAGLLFGEEKTLTGRTLAEEVERAYREQEGQKVVFPVEKALKPHGGLVVLKGNLAPKGAVLKLAGTERTYFEGPARVFDSEEAAMEKVLKGEIRPGDVVVIRYVGPKGAPGMPEMLSVTSAIVGEGLGPEVALLTDGRFSGGTRGLMIGHIAPEAFVGGPIALLEEGDRIRIDVEGRRLEVLLPEEELERRRARWRPRPPAFTHGLFARYAALVRQADEGAVLEDPL

SEQ ID NO: 568 - DNA, 1668 bp, Thermus thermophilus
atgaggtcggaccagatcaagaagggactcaagcaggcccccgcccgcgccatgctccgggcggtgggggtaggggacgaggacttcggaaggcccttcgtgggggtggtgaacaccttcaccgacgggatgccctgcaacttccacctgcgggagctggcccagcacctcaaggccgggctcaaggaggcggggcttttcccctttgagttcggggctcccgccatctccgacgggatcagcatgggcaccccgggcatgcgggcgagcctcgtaagccgcgaggtcatcgccgacagcgtggagctcatcgcccagggctacctctacgacggcatggtggggctttccgcctgcgacaagaccatcccgggaacggccatgggggtgatccgcagcggcgtccccggcatgatcctctacggggggacgatcgcccccggggagtggcaaggccggaagctcaccatcgtggaggtctttgaggcggtggggcaaagggccgcggggaagatcagcgaggaggagcttttggagattgaacgccgggccatccccggccccggggcctgcggcggccagtacaccgccaacaccatggccatggccctcgaggccctgggcctctcccccgtgggctacaacgccatccccgccgtccaccccgaaaaggagcgggccaccaaggaggcggggaaaatcctcgcctgggccatcgcccacgactggaagcccaaggacttcctcacccggaaaagcttcctcaacgccatcgccgccgtggccgccacgggggggagcaccaacgccgtcctccacctcctcgccctggccaaggaagcgggggtggagctcagcctggacgactttgaccagatttcccgcaagaccccggtgatcgcggacctccgcccttggggcacctacaccgcctgggagctctacgaagccggggggacagccctcgtcttcaagcggcttctggaggcggggctcctctttggggaggagaagaccctcacgggccgcaccctggcggaggaggtggagcgggcctaccgggaacaagaggggcagaaggtggtcttccccgtggagaaggccctcaagccccacggggggctcgtggtgctcaagggaaacctcgcccctaaaggcgccgtcctcaagctcgcggggacggagcgcacctactttgagggcccggcccgggtctttgactcggaggaggcggccatggagaaggtcctgaagggggagatccggcctggggacgtggtggtcatccgctacgtgggccccaagggggcaccggggatgcccgagatgctctcggtgacgagcgccatcgtgggggaaggcctggggccggaggtggccctcctcaccgacggccgcttctccgggggcacccgcggcctcatgatcggccacatcgcccccgaggccttcgtgggcgggcccatcgccctcctggaggagggggaccgcatccggattgacgtggaaggccgccgcctcgaggtcctcctccccgaggaggagctggaaaggcggagggcccgctggcggccccgaccccccgccttcacccacggcctcttcgcccgctacgccgccctggtgcgccaggcggacgagggggcggtgctggaagacccgctctag

SEQ ID NO: 569 - protein, 562 aa, Anabaena variabilis
MSENLRSQIVTQGVQRSPNRAMLRAVGFKDEDFNKAIVGIANGYSTITPCNMGINQLALRAEVGIKSAGAMPQMFGTITISDGISMGTEGMKYSLVSREVIADSIETACTGQSMDGVLAIGGCDKNMPGAMLAIARMNIPAIFVYGGTIKPGHYNGRDLTVVSSFEAVGQYSAGKIDDKELLEVESHACPGAGSCGGMFTANTMSGAFEALGMSLPYSSTMAAEDAEKADSTEKSAFVLVEAIRKQILPSQIITCKSIENAISVIMAVGGSTNAVLHFLAIAHAANVELTLDDFETIRARVPVLCDLKPSGKYVATDLHEAGGIPQVMKMLLVHDLLHGDCLTITGQTIAEILADIPEEPSVNQDVIRTWNNPMYPQGHLAILRGNLATEGAVAKITGVKKPVITGTARVFESEEASLDAILAGKIQAGDILVIRYEGPKGGPGMREMLAPTSAIIGAGLGDAVGLITDGRFSGGTYGMVVGHVAPEAAVGGAIALVEEGDSITIDAPARLLQLNISDHELARRHANWQPPVPRYTKGVLAKYAKLVSSSSLGAVTDLDLFN

SEQ ID NO: 570 - DNA, 1689 bp, Anabaena variabilis
atgtcggagaatttaagaagccaaattgtgacccaaggggtgcagcgatcgcctaatcgagctatgctgcgtgcagttggttttaaagatgaagattttaataaagccattgtgggtatagccaatggttacagcactatcacgccctgcaatatggggataaatcaactggcgctcagagcagaagttggcataaagtctgccggagcaatgccacaaatgtttggcacaattaccatcagcgacggcatttcgatgggaactgaagggatgaaatattccctagtgtcgcgggaagtcattgctgattccattgaaaccgcctgtactggacaaagtatggatggtgtactagccattggcggttgtgataaaaatatgccaggagcaatgctagcgatcgcgcggatgaatatccctgcaatattcgtttacggtggcacaattaaacctggtcactataacggacgcgatttaactgttgtcagttcttttgaagctgttggtcaatacagtgctggaaaaattgacgacaaggaattattagaagtcgaaagtcatgcttgtcctggtgcaggttcctgcgggggaatgttcacggctaacaccatgtcgggagcatttgaagcactggggatgagtttaccttattcttcgacaatggcagccgaagatgccgaaaaagccgacagcacggaaaaatcagcatttgtattagtcgaagccattcgtaaacaaatcttacccagccaaattatcacctgcaaatctatagagaatgccatctctgtgattatggcggtgggtggttcgaccaatgcagtgttgcattttttagcgatcgcccacgctgctaatgtagagttaactctggatgactttgaaactatccgcgctcgtgttcccgttttgtgtgatttaaaacctagtggtaagtatgtcgctaccgatttgcacgaagctggtggcattccccaagtcatgaagatgctactcgtgcatgacttgttacatggtgattgcctgaccatcactggtcaaacaattgcagagatattagcagacatacccgaagaaccatctgttaatcaagatgtaattcggacttggaataacccgatgtatccccaaggacacttagccatcctcagaggtaatctggcaacagaaggtgctgtcgctaaaattactggcgtgaaaaaaccagtaattaccggaactgcaagggtgtttgagtcggaagaagcttctttagatgcaattttggcggggaaaattcaagctggtgatattttggttatccgctacgaagggcccaagggtggccctggaatgcgagaaatgttggctcccacttcggcaattattggtgctggcttgggtgatgcggtgggattaattaccgatgggcgcttttctggcggtacttacggtatggtagttggtcatgttgctccagaagcagccgtgggtggtgcaatcgctcttgtagaagaaggcgatagtattaccattgatgcacctgcacgtctcttgcagttgaacatatctgatcatgaattagctcgtcgtcatgctaattggcaacctcctgtaccacgttacactaaaggcgtgttggcgaaatatgccaaattggtatcttctagcagtcttggggctgtgacagatttggatttgtttaattga

SEQ ID NO: 571 - protein, 585 aa, Roseovarius sp.
MTKFDKAKLPSRHVTEGPERAPHRSYYYAMGMTEAEIHQPLVGVATCWNEAAPCNISLNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVEEIPADFRSRDLTVQDMFEAVGRHQNAEMSDKALDMLERVACPSAGACGGQFTANTMACVSEAIGLALMNSSGMPAPYESRDQYAEASGRAVMQLLEKNIRARDVVTLKSLQNAARVVACTGGSTNAGLHLPAIAHEAGIDFFLEDVCDIFRDTPYFVDLKPGGAYVAKDLYDAGGIPVVMKELRKAGLIHEDCMTASGRSIGEELDLIERVADGKVIYPIETPITKTGGVVGLKGNLAPTGAIVKVAGIAPEHQVFTGPARVFECEEDAFEAVKARNYKEGEVIVIRNEGPAGGPGMREMLSTTAALSGQGMGKKVALITDGRFSGATRGFCVGHVGPEAAHGGPIALIATGDMITIDAIKGELSVDLSDEDLAARKAAWAGPRETIYASGALWKYAQLVGETYKGAVTHPGAAFERHVYMDL

SEQ ID NO: 572 - DNA, 1758 bp, Roseovarius sp.
atgaccaagttcgacaaagccaaactgcccagccgccatgtgaccgaaggaccggagcgcgcgccgcatcggtcctattactatgccatgggcatgaccgaggcggagatccatcagcccttggtcggtgtggcgacctgctggaacgaggcggccccctgcaatatctcgctcaaccgtcaggcgcaggccgtcaagggcggcgtgaaagaggcgcatggcagcccgcgcgagttcaccacaatcacggtgacggacggcattgcgatggggcatgagggcatgcgcagttctctggcgagccgcgaggcgattgccgatacggtggaattgacgatgcgcggccattgctatgacgcgctggtggggctggcgggctgtgacaagagcttgccggggatgatgatggcgatggtgcggttgaatgtgccgtcggtgttcatctatggcgggtcgatccttccgggcaaggcgccgcaggtcgaggaaatcccggcggatttccgcagtcgcgatctgaccgtgcaggatatgttcgaggccgtggggcggcatcagaacgccgagatgtccgacaaggcgctcgatatgctggagcgggtggcctgcccgtcggcgggagcctgtggtgggcaatttactgccaataccatggcctgtgtgtctgaggcgatcggtctggcgctgatgaattcctcgggcatgcccgcgccctatgagagccgtgatcaatatgccgaggcctctggccgggcggtgatgcagctcctggaaaagaacatccgggcgcgcgatgtggtgacgctcaagagtttgcagaatgcggcgcgggtcgtggcctgcaccggcggcagcaccaatgctggtctgcacctgcctgcgattgcgcatgaggcggggattgatttctttcttgaggatgtctgcgacatcttccgcgacacgccctatttcgtcgatctgaagccgggcggggcctatgtggccaaagacctttatgacgcgggcggcatcccggtggtgatgaaggaactgcgcaaggcggggctgatccatgaggattgcatgaccgcgagcgggcgcagcatcggcgaagagctggacctgatcgagcgtgtggccgatggcaaggtgatctatccgattgaaacgccgatcaccaagaccggcggcgttgtcggcctcaagggcaatctggccccgacgggtgcgattgtgaaggtcgcggggattgcccctgagcatcaggtctttaccggcccggcgcgggtgtttgagtgcgaagaggatgcgttcgaggcggtcaaggcgcgcaattacaaggagggcgaggtgatcgtcatccgcaacgagggcccggcgggcggccccggcatgcgtgaaatgctgtcgaccacggcggcgctcagcggtcagggcatgggcaagaaggtggcgctgattaccgatggccggttctcgggcgcgacgcgtggcttctgcgtgggccatgtcggccccgaggcggcgcatggtgggccgattgccctgattgccaccggtgacatgatcacgattgacgcgatcaagggtgagttgtcggtggatctgagtgacgaggatctggccgcgcgcaaggccgcgtgggccggtccgcgcgagacgatctatgccagcggggcgttgtggaaatatgcgcaattggtgggcgagacctacaagggcgctgtgacccatcccggtgcggcgttcgagcggcatgtctatatggacctctga

SEQ ID NO: 573 - protein, 557 aa, Prochlorococcus marinus
MNKLRSSAITQGVQRSPNRSMLRAVGFNDEDFNKPIIGVANGYSTITPCNVGLNKLALKAEESIKRSGGMPQMFGTITVSDGISMGTEGMKYSLVSREVIADSIETACNAQSMDGVLAIGGCDKNMPGAMIAIARMNIPSIFIYGGTIKPGKLHGEDLTVVSAFEAVGQLTSGKINEERLIQVEKNCIPGAGSCGGMFTANTMSAVIEVLGLSLPHSSTMAAEDLEKELSADKSAEILVSAIEKDIKPLDLMTKKAFENAISVIMAIGGSTNAVLHILAIANTAGIDININDFERIRQKVPVICDLKPSGKYVTVDLHKAGGIPQVMKILLNAGLIHGDCKNIEGKTISEYLQNIPDKPPTNQNVIRDINDPLYKKGHLAILKGNLASEGSVAKISGVKNPVLTGPAKIFESEEDCLKSILNNDIKAGDVVVIRNEGPVGGPGMREMLAPTSAIVGQGLGEKVALITDGRFSGGTYGLVVGHIAPEAAVGGNIALIKQGDLITVDAAKQLIEVDLSDEELEKRKKDWVKPIQKYKRGILSKYSRIVSTSSLGAVTDL

SEQ ID NO: 574 - DNA, 1674 bp, Prochlorococcus marinus
atgaataaactcagatcatctgcaataacacaaggtgtgcaaagatcccctaacagatcgatgttaagagctgttggatttaatgatgaagattttaataaacctattatcggagttgcaaatggatacagtaccataacaccatgcaatgtaggtttaaataagttagctctcaaagctgaagagtcaataaaaagatcaggtgggatgcctcagatgtttggaacgataacagtaagtgatggtatttctatgggaacagagggcatgaaatattccttagtttcaagagaagttattgctgattcaattgaaacagcatgcaatgctcagagtatggatggagtgcttgctataggtggatgtgacaaaaatatgccgggtgccatgatagcgattgcaagaatgaatattccctcaattttcatttatggagggacgatcaaacctggaaagttgcatggagaagatcttactgttgttagtgcatttgaagctgttggacaattaacatcaggcaaaattaatgaagaaaggctaatccaagttgagaaaaattgtattcctggtgctggcagctgtggagggatgtttacagctaatacaatgtctgcagttattgaagttttagggttaagtcttcctcacagttccactatggctgctgaagatctcgaaaaagaactaagtgcagataaaagtgctgagatattagtctctgcaattgaaaaagatataaaacctctagacctaatgactaagaaagcatttgaaaatgcaatatcagtaattatggcaattggcggatcaacaaatgcggtgttgcacatcttagctattgcgaatactgcaggaatagatatcaacattaatgattttgaaagaatcagacaaaaagtaccagttatttgtgaccttaaaccgagtggtaaatatgtgacggtggatctgcataaggcaggtgggattccacaagtaatgaaaatactattgaatgcaggattaattcatggcgattgcaaaaacattgaaggcaaaaccatctcagaatacttacaaaatattccagataagcctccaaccaatcaaaatgtcataagagacataaatgaccctctttataaaaaaggacatctagcgatattaaaaggtaacttagcgagcgaaggttctgtagctaaaattagcggagtaaaaaaccctgtattaacaggtcccgcaaagatttttgaaagtgaagaggattgtttaaaatcgatattaaataacgatatcaaagcaggtgatgttgttgttattagaaacgaaggtcctgtaggaggtccaggcatgagagaaatgttagctccaacatctgcgattgttggtcaagggcttggagagaaggtggctttaattacagatggcagatttagcgggggtacctatggtcttgttgtaggtcacatagctccagaggctgccgtaggaggaaatattgctctaataaaacaaggtgatttaattacagtagatgctgcaaaacaactaattgaagttgatttatctgacgaagaattagaaaaaaggaaaaaagattgggtaaaacctattcaaaaatacaaaagaggaattctttcaaaatattcgagaatcgtaagcacttcaagtttaggggctgttactgatttataa

SEQ ID NO: 575 - protein, 588 aa, Burkholderia xenovorans
MTNLHKHRSRRVTDGVTRAPHRAFLRATGLDDESMQKPFVAIVDTFGENTPCSMSLNQVSDNARLGIAAGGGVPIRGSAISVSDGTSMNHSGMRMSLVSREVVADSVELFVRAHNYDALIGVAGCDKTLPGILMGMVRVNVPGVFLFGGAMLPGVAPGQLPGGAGHGLRRQATILSTIEAVGTAQRGDISRAQLDAIEKQCTPTAGSCPGQFTANTMAMVAETLGLAPLGSAMVPAVYSERIAIARRAGETVMRILKQGGPLPRDLVTLESLENACAAVAATGGSTNAALHIPAIANEAGIRFTLDDVQRVFAKIPLIGDLQPGGRYLAQDLHHAGGVPAVLNALLEGGFLHGDAPALGGGTLADALNAYDGPDGTVVRPCSEPLGENGGLVILRGNLAPDGACLKIAGLKSLTFTGAVRIFECEEDCMAVVAARDYREGDVLVIRNEGPKGGPGMREMLSVTAAIYGQGMGEKVALLTDGRFSGATRGMCIGYVGPEAAAGGPIGLLRNGDRVHIDAREGILRVDLSDDELARRRASAPARPPRRLAGVLEKYEALVRPAHLGAVTHSGNVEWPYDAPTPGDDGAAE

SEQ ID NO: 576 - DNA, 1767 bp, Burkholderia xenovorans
atgaccaatctgcacaaacatcgctcgcgcagggtgaccgacggcgtcacgcgggcgccgcatcgcgcgttcctgcgcgccaccggtctcgacgacgaatcgatgcaaaagccgttcgtcgcgatcgtcgatacgttcggcgagaacacgccgtgttcgatgtcgctcaaccaggtctccgacaacgcgcggctcggcattgccgcgggcggcggcgtgccgatccgcggttcggcgatctcggtgtcggacggcacgtcgatgaatcactccggcatgaggatgagcctcgtgtcgcgcgaagtggtggccgatagcgtcgagctgttcgtgcgcgcgcacaactacgatgcgttgatcggcgtcgccggttgcgacaagaccttgcccggcatcctgatgggcatggtgcgcgtcaacgtgcccggcgtgttcctgttcggcggcgcgatgctgcccggcgtcgcgcccggccagttgcctggcggagcgggccacggcctgcgccgccaggccacgattctcagcacgatcgaagcagtcggcaccgcgcagcgcggcgacatcagccgcgcgcaactcgacgccatcgaaaagcaatgcacgccgaccgccggctcgtgtcccggccagttcaccgcgaatacgatggcgatggtcgcggaaacgctgggcctcgcgccgctcggttccgcgatggtgccggccgtctacagcgaacggattgcgattgcgcgccgcgcgggcgaaacggtgatgcgcatcctcaaacagggtggcccgttgccgcgcgacctcgtcacgctggaaagcctcgaaaacgcctgcgcggcggtcgcggcaaccggcggctcgaccaacgcagcgctgcatattccggcaatcgccaacgaagccggcatccgcttcacgctggacgacgtgcagcgcgtgttcgcgaagattccgctgatcggcgatctgcaaccgggcggccgctatctcgcccaggatctgcatcatgccggcggcgtgccggccgtgctgaatgcgctgctggaaggcggctttctgcatggcgacgcaccggcgctcggcggcggcacgctcgccgacgcactgaatgcgtacgacggaccggacggcacggtggtgcgcccgtgcagcgaaccgctcggcgagaacggcggcctcgtgatcctgcgcggcaatctcgcaccggacggcgcatgcctgaagatcgccgggctgaagtcgctgacgttcacgggcgcggtacgaattttcgagtgcgaagaggactgcatggcggtggtcgccgcgcgcgattatcgcgaaggcgatgtattggtgatccgcaacgaaggcccgaaaggcggtcccggcatgcgcgaaatgttgagcgtcacggcggcaatctacggccagggcatgggcgaaaaagtggcgctgttgaccgatggccgtttctccggcgcgacacgcggcatgtgcatcggctacgtggggccggaagcggcggccggcggaccgatcggcctgctgcgcaacggcgaccgcgtgcatatcgacgcgcgcgaaggcattctgcgcgtcgatctgtccgacgacgaactcgcccggcgccgcgccagcgcgcccgcgcgcccgccgcgccgactcgccggcgtgctcgaaaaatacgaggcgctggtgcggcccgcgcatctcggcgcggtcacgcactcgggcaacgtcgaatggccgtacgatgcgccgacgcccggcgacgacggagccgccgaatga

SEQ ID NO: 577 - protein, 571 aa, Saccharomonospora viridis
MAEAHPVDPRPRSREVTDGLERTAARAMLRAVGMGDADFAKPQVGIASSWNEITPCNLSLRRLAEASKQGVHAGGGYPLEFGTLSVSDGISMGHQGMHFSLVSREVVADSVETVLEAERLDGAVLLAGCDKSLPGMLMAAARVDVAAVFVYAGSTLPGRVDDRELTIIDAFEAVGACSRGLMSAEDVERVERAVCPGEGACGGMYTANTMACAAEALGMALPSSASPPSVDRRRDVLARASGEAAVELLRRGITATDVLTREAFENAIAVVMAFGGSTNAVLHLLAIAHEAGVPLSLDDFSRIGDRVPHLADVKPFGRYVMATVDRVGGVPAVMRALLEAGLLHGDCLTVTGRTVAENLAEIDPPELDGTVIRRLDDPLHPAGGITILYGSLAPEGAVVKSAGFDATRFEGRARVFDGEQAAMAALNELSAGDVVVIRNEGPRGGPGMREMLAVTGAIKGAGLGRDVLLLTDGRFSGGTTGLCVGHVAPEAAHGGPIAFVRDGDPIAADLSTRTLELRVDDAELARRREGWRPPGIAHRGVLGKYARLVGSASRGAVCPASSESPRDYPTG

SEQ ID NO: 578 - DNA, 1716 bp, Saccharomonospora viridis
atggccgaagcacaccccgtcgaccccagaccccgcagccgggaggtcaccgacggtctcgaacgcacggccgcgagggcgatgttgcgggcggtggggatgggtgacgccgacttcgcgaaaccgcaggtggggatcgcgtcgtcgtggaacgagatcaccccgtgcaacctgtcgctacgcaggctcgcggaggcgagcaaacagggtgtgcacgccggcggcggatatccactggaattcggcacgctctcggtctccgacgggatcagcatgggacatcagggcatgcacttctccctggtgtcgcgcgaggtcgtcgccgattcggtcgagacggtgctggaggccgagcgactggacggcgcggtgctgctcgccggatgtgacaagagtctgcccggcatgctcatggccgccgctcgcgtcgacgtcgccgccgtgttcgtctacgcgggatcgacgctgccgggacgtgtcgacgatcgggagctcacgatcatcgacgcgttcgaggccgtgggcgcgtgttcccgtgggctgatgagcgccgaggacgtcgaacgggtcgagcgcgccgtgtgtcccggcgagggtgcgtgcggcggcatgtacacggccaacacgatggcgtgcgcggcggaggcgttggggatggcgctgccgtcctcggccagtcccccgtcggtcgatcggcgcagggacgttctggcccgtgccagcggggaggccgccgtcgagctgctgcgcagggggatcacggcaaccgacgtcctcaccagggaggcgttcgaaaacgccatcgcggtggtgatggccttcggcggctccaccaacgccgtgttgcacctactggcgatcgcgcacgaagccggggtaccgctgtcgttggacgacttctcccggatcggtgatcgcgttccgcacctggcggacgtcaagccgttcgggcggtacgtgatggcgacggtcgaccgggtcggcggggtgccggcggtgatgcgggcgttgctcgaggcggggctgttgcacggcgactgcctcaccgtcaccgggcggacggtggcggagaacctcgcggagatcgacccacccgaactggacgggaccgtcatccgccgactcgacgaccccctccaccccgccggggggatcaccatcctgtacggcagtctcgcgccggagggcgccgtggtgaaaagcgccggtttcgacgccactcgcttcgagggccgggcccgcgtcttcgacggcgaacaggcggcgatggcggcgctgaacgagttgtccgcgggcgatgtcgtggtgatccggaacgaagggccgcgtggtgggccggggatgcgggagatgctggccgtcaccggtgcgatcaaaggggcggggctcggtcgtgacgtgttgctgctgaccgacggccgcttctcgggcggcaccaccgggctgtgcgtcgggcacgtcgcacccgaagcggcacacggtggaccgatcgcgttcgtccgtgacggcgatccgatcgcggccgacctgtcgacgaggacactggagttgcgggtggacgacgcggaactcgctcggcgtcgagagggctggcggccaccggggatcgcccaccggggtgtgctgggcaagtacgcgcggctggtggggtcggcctcgcggggtgccgtgtgcccggcgtcgtcggaaagcccgcgcgactacccgaccggatga

SEQ ID NO: 579 - protein, 565 aa, Pedobacter heparinus
MSQTPEINRYSKTFTQDPTQPAAQAMLYGIGLTAADMDKAQVGIASMGYDGNTCNMHLNDLAKIVKEGVWKNDMVGLTFSTIGVSDGMSNGTDGMRYSLVSRDVIADSIETICGGQYYDGLITIPGCDKNMPGSVMAMGRLNRPSIMVYGGSIHSGKWKGQSLNIVSAFEALGQKLAGNLEEEDFQGVIKNACPGAGACGGMYTANTMASAIEALGMSLPYSSSHPATSDEKKNECLEAGKYIRILLERNILPSDIMTEKAFRNAIVIVMVLGGSTNAVLHLIAIARSVGIDLKLDDFQHISDSTPVLGDLKPSGTYLMEDLHEIGGVPAVMKYLLKVGLIDGDCITVTGKTIAENVADAADLDFETQKIIFPIENPIKETGHLQMLYGNLATKGAVAKISGKEGERFTGPARVFDGEKSLMAGIQSGRLKSGDVVVIRQVGPKGAPGMPEMLKPTSLIIGAGLGKSVALITDGRFSGGTHGFVVGHITPEAWDGGNIALVHDDDIITIDAVNNSIDVHLTDEQLATRRAVWKQLPPPVTKGVLYKYLKQVSNASEGCVTDAYTD

SEQ ID NO: 580 - DNA, 1698 bp, Pedobacter heparinus
atgtcacaaacacctgaaattaaccgatacagcaaaacatttactcaagatcctacacagccggctgcacaggccatgttgtatggaattggactgaccgcagcagatatggacaaagcccaggtgggcattgccagcatgggctatgatggaaacacctgcaacatgcacctgaatgatctggccaaaattgtaaaagaaggtgtctggaaaaatgatatggtgggattaaccttcagcaccattggcgtaagtgacggtatgtcgaacggaacagatggcatgcgttactccctggtttcaagagatgtaattgccgattctattgaaactatctgcggtgggcagtattatgatggtttgatcaccattcctggctgtgataaaaatatgccaggttctgttatggccatgggccgtttaaaccgcccttctattatggtatatggcggcagtatccattcgggtaaatggaagggacaatcattaaacattgtatctgcttttgaagcattgggccagaaacttgccggcaatttagaagaagaggattttcagggtgtaattaaaaatgcatgtccgggtgctggtgcctgtggtggtatgtataccgcaaataccatggcttcggctattgaggctttaggaatgagtttgccttacagctcttcccacccggccacaagtgatgaaaaaaagaacgaatgcctggaagcaggtaaatacatccgtatcctgctggaaagaaatatcctgccttcggatatcatgaccgagaaagcatttcgcaatgcaatcgtaattgtgatggtactgggcggatctacaaatgcagtactgcacctgattgccattgccagatctgtaggtatagacctgaaactggatgatttccagcacatcagcgacagcaccccggtactgggcgacttaaaaccaagcggaacttacctgatggaagatctgcatgaaataggtggtgtacctgcggtaatgaaatatttgttaaaagtgggtttaattgatggcgactgtataactgtaaccggaaaaaccattgctgaaaatgttgctgatgcggcagacctggattttgaaacccaaaagattattttccctatagaaaaccctattaaagaaaccggccacttacaaatgttatatggcaacctggctaccaaaggggctgttgcaaagatcagtggtaaggaaggagagagatttactggcccggcacgcgtatttgacggagagaaatcgctgatggcaggtatacagagcggacgcctgaaaagtggggatgtagtagtgatcagacaggttggccctaaaggcgcccctggaatgccagagatgttgaaacctacttcattgattattggcgcaggtttgggtaaatcagtagccctgattactgacggtcgtttttctggtggtacacatggttttgtggtaggccacatcactcctgaagcatgggatggcggaaacattgccctggtacatgacgatgacatcattactatagatgcagtaaacaattctatagatgtacacctgactgatgagcagctggcaacccgccgcgcggtatggaaacaacttccgccacccgtcaccaaaggtgtgctttacaaatacctgaaacaagtaagcaatgccagtgaaggctgcgttactgatgcctatacagattaa

SEQ ID NO: 581 - protein, 567 aa, Microcoleus chthonoplastes
MSDNLRSQVVTQGVQRSPNRAMLRAVGFSDRDFTKPIVGLANGYSTITPCNMGINDLALRAEAGLKQAGAMPQVFGTITISDGISMGTEGMKYSLVSREVIADSIETVCNGQSMDGVLAIGGCDKNMPGAMIAIARLNIPAIFVYGGTIKPGHLDGQDLTVVSAFEAVGQHSAGKITEEQLVAVERNACPGAGSCGGMFTANTMSSAFEAMGMSLPYSSTMAAEDAEKADSTEKSAFVLVDAIRQQILPKQILTRQAFENAISVIMAVGGSTNAVLHLLAIARAIGVELSLDDFETIRAKVPVLCDLKPSGRYVATNLHQAGGIPQVMKMLLVHDLLHGEALTITGQTLAEVLADVPEEPPSDQDVIRPWDNPMYTQGHLAILKGNLATEGAVAKITGVKTPQITGPARVFESEEACLDAILAGKIQAGDVIVVRYEGPKGGPGMREMLAPTSAIIGAGLGDSVGLITDGRFSGGTYGMVVGHVAPEAAVGGAIALVEEGDSITIDAPARLLQINISDQELQQRRAKWQPAKPRYTKGVLAKYAKLVSSSSLGAVTDFESVMNQITE

SEQ ID NO: 582 - DNA, 1704 bp, Microcoleus chthonoplastes
atgtcagacaacctgagaagtcaagtcgttacccaaggtgtgcaacgatcgccaaatcgtgccatgcttcgtgctgtcggttttagcgatcgcgattttactaagccaattgttgggttagcgaatggttatagtacaatcacgccctgtaatatgggcatcaatgatttagcgctaagggcagaagccggactgaaacaagcgggggcgatgccgcaagtctttggtactattacgattagcgatggtatctctatgggtactgaggggatgaaatattccctggtgtcacgggaagtgattgctgactccatcgaaaccgtctgtaatggtcaaagtatggacggggtgctggcaattggtggctgtgataagaatatgcccggggcgatgattgcgatcgcgcggctgaatattcccgctatttttgtctatgggggaacgattaaacccggacatctggatggacaagatttaaccgttgtcagcgcctttgaagcagtgggacaacatagcgcgggtaagattacagaagaacaactggtagccgtcgaacgaaatgcttgtcctggtgcgggttcttgtggggggatgttcacggctaacactatgtcctcggcatttgaagccatggggatgagtttaccctattcctcgacgatggcggcggaagatgccgaaaaagcagatagtacggaaaaatcggcgtttgttctggttgatgcgattcgtcagcaaatcctgcctaagcagattttaacccgccaagcctttgaaaatgccatctcggtaattatggcagtgggtggatcaacgaatgcggtactgcatttactggcaattgcgcgggcgatcggggtagagttatccctggatgactttgaaaccattcgtgctaaagttccggttctgtgtgatcttaaacccagtggcagatatgtagcgacaaacttacatcaggcgggtggtattccccaagtgatgaaaatgctgctggttcatgatttgttacatggtgaggcattaacgattacggggcaaaccctagcggaagtcttagccgatgtacctgaggaaccaccctcagatcaagatgtgattcgtccctgggataatcccatgtatactcaaggacatttggcgattttaaaaggaaatttggcaaccgaaggtgcggtggcgaagattacaggcgtgaaaaccccccaaattacgggtccagcacgagtctttgaatccgaggaagcctgtctggatgcaattttggcgggtaagattcaagctggagatgtgattgtggtgcgttatgagggacccaaaggaggtccgggaatgcgggaaatgttagcgccaacctcagcaattattggtgctggcttaggggattccgtgggattaattaccgatggtcgcttttctggtgggacctatggtatggtggtcggtcatgttgccccagaagccgccgttgggggtgcgatcgcgttagtcgaagaaggggattcgattacgattgatgctccggcgcgattattacagattaatatatccgatcaggaactgcaacaacgccgcgccaagtggcaacctgccaaaccccgatataccaaaggagtgctggcgaagtatgccaaattagtgtcttctagcagtttgggtgcggtgacagattttgaatcggtgatgaatcagataacggagtga

SEQ ID NO: 583 - protein, 567 aa, Acidimicrobium ferrooxidans
MERRQLKVRSRDVTEGPTRAPARAMLRAVGLVEEDFDKPQIAVASSWNEVTPCNLPLGELAKRVKAGVRSAGGVPLEFATIAVSDGISMGHEGMHSSLVSREVIADSVELMVHAERMDGLVTLAGCDKSLPGMMMAAARLDLASVFVYGGSILPGHLKDQRLDIVSVFEAVGAYAAGQISQDELSAIERNACPTPGSCAGMYTANTMASVSEALGLAPLGSASAPAVDRRRADAAFEAGELVMRQLELGITARRILTKEAFENAIATVMALGGSTNAVLHLMAIANEARVELRLDDFNRIAARVPHLADTKPHGKFYMTDIDRVGGVPVVLRELAEAGLVHTDVLTATGRTLGDELDAYDPPAADGVVIHRLDDPIHAVGGIAVLTGSLAPRGSVVKVAGIDQDVFEGTARVFDREEAALTAILAGEIRAGDVVVIRYEGPKGGPGMREMLAVTGAMKGAGRGSDAALVTDGRFSGGTHGLCVGHVAPEAADGGPIALVRDGDRIRIDVPNHAIDLLVAPDELERRRASFAPLPPRYTSGALAKFAALVRGADVGAVTSAGFDDDSR

SEQ ID NO: 584 - DNA, 1704 bp, Acidimicrobium ferrooxidans
gtggagcggcggcagctgaaggttcggagccgggacgtcaccgaggggccgacgcgagcaccagcgcgcgcgatgcttcgcgcggttgggctggtcgaggaggacttcgacaagccgcagattgcggtcgcctcatcgtggaacgaggtgacaccatgtaatttgccgctcggtgagctcgccaagcgggtcaaggctggcgtgcggtcagccggcggcgtgccgctcgagttcgcaaccatcgcggtatcggacggcatctccatgggtcatgaggggatgcactcgtccctcgtgtcgcgcgaggtcatcgcggattcggtggagctcatggtgcacgccgagcgcatggacggactcgtgacgcttgccgggtgcgacaagtcgctccccggcatgatgatggccgcggcacggctggacctagcgagcgtgttcgtctacggcggctccatcctcccgggtcatctgaaggatcagcggctcgacatcgtctcggtgttcgaggcggtcggtgcatatgctgccggacagatcagccaggacgaactgagcgcgatcgagcgcaacgcgtgcccgacgcccggttcgtgcgcgggtatgtacaccgccaacaccatggcctcggtgtccgaagcgctgggcttggcgccgctcgggtcggcgtccgcgccagcggtggatcgccgtcgtgcagacgcggcgttcgaggcgggcgaactcgtcatgcgccagctcgagctcgggatcacggcgcgacgcatcctcaccaaggaggccttcgagaacgccatcgcaaccgtcatggcgctcggcgggtcgacgaacgccgtcttgcacctgatggcgatcgcgaacgaggcccgtgtcgagctgcggctcgatgacttcaaccggatcgccgcgagggttccgcacctcgccgacaccaagccgcacggcaagttctacatgaccgacatcgaccgcgtcggcggggtcccggtcgtgctgcgtgagctggccgaggcgggtctcgtccacaccgacgtactcacggccacggggcgaaccctcggtgatgaactcgatgcgtatgatccgccagcggccgatggagtcgtgattcaccgtctcgacgacccgattcatgccgtcgggggtatcgccgtgctgacgggaagcctcgcgccgcgcggatcggtcgtgaaggtggccggcatcgaccaggatgtcttcgaggggacggcccgggtgttcgaccgcgaggaagctgccctgaccgccatcttggccggggagatccgcgctggcgacgtcgtcgtgatccgctacgagggcccgaagggcgggcccggcatgcgcgagatgctcgccgtgaccggtgcgatgaagggggcgggacgcggttcggacgcggcgctcgtcaccgacggtcgcttttcggggggcacccatggactgtgcgtcggtcacgtggctcccgaggccgccgacggcggcccgatcgcgctcgtgcgcgacggggaccggattcgcatcgacgtcccgaaccatgcgatcgatctactcgtcgccccggacgagcttgagcgacgacgagcgtcgttcgcgcccttgccccctcgctacacgagcggtgcgctcgcgaagttcgcggcgctcgtgcgcggtgccgatgttggggcggtgacctcggcaggattcgacgacgactcgcgctag

SEQ ID NO: 585 - protein, 607 aa, Rhodobacterales bacterium
MRLATLPLLIYPLSNAYFGEPAMTKFDKSKLPSRHVTEGPARAPHRSYYYAMGMSEEEIHQPLVGVATCWNEAAPCNISLNRQAQAAKMGVKAASGSPREFTTITVTDGIAMGHEGMRSSLASREAIADTVELTMRGHCYDALVGLAGCDKSLPGMMMAMIRLNVPSVFVYGGSILPGRAPAGAKVPEAYADRDLTVQDMFEAVGHQQNGTMTEAELEILERVACPSSGACGGQFTANTMACVSEAIGLALLNSSGAPAPFESRDEYSKASGIAVMNLIEKGIHARDVCTREAFENAARVVACTGGSTNAGLHLPAMAHEAGIDFYLEDVCDIFRDTPYFVDLKPGGQYVAKDLYEAGGVPVVLNELRRAGLLHEDCMTATGYSIGEELDMHTLKADGRVVYPVETPITKTGGVVGLKGNLAPEGAIVKVAGMAAQHQRFVGPARIFECEQDAFEAVQNRTYKEGDVFVIRNEGPAGGPGMREMLATTAALSGQGMGLKVALITDGRFSGATRGFCVGHVGPEAAHGGPIALLQQGDVITLDAVEGTLDVDISDEEMAKRRADWKGPRETIYASGALWKYADQVGEIYKGAVTHPGGKAEKHAYWDL

SEQ ID NO: 586 - DNA, 1824 bp, Rhodobacterales bacterium
ttgcgccttgcgaccttgcctttgctgatttatccactctccaacgcatatttcggagagcccgctatgaccaagttcgacaaaagcaaactgccaagccgccatgtcacagaagggccagcgcgcgcgccgcaccgttcgtattattacgcgatgggcatgtctgaggaagaaattcaccagcccctggtaggtgttgccacatgctggaacgaagccgcgccgtgcaacatttctttgaaccgtcaagcacaggccgcaaagatgggtgtcaaagccgcctctggcagcccgcgtgagttcacgaccatcaccgtcacggacggcattgcaatgggtcatgagggcatgcgcagctccttggcgtcacgtgaagcgattgctgatacggttgaattgaccatgcgtggtcactgctacgacgcgcttgtgggccttgcaggctgtgacaaatccttgccgggcatgatgatggcgatgatccgtctcaacgtgccgtccgtgtttgtctacggtggctccatcctgccgggtcgcgcacctgccggcgcgaaggttccagaggcctatgcagatcgcgatcttacggttcaggacatgtttgaagccgtgggccatcagcaaaacggcacaatgaccgaagcagagctggaaatcctagagcgtgtggcttgcccatcttctggcgcatgtggtggccagttcaccgccaacacgatggcctgtgtgtccgaggcgattggccttgcgttgctgaattcctccggtgcccctgccccgttcgagagccgtgatgaatactccaaagcctccggcattgccgtgatgaacctgattgaaaaaggcattcacgcacgcgacgtctgcacacgcgaagcgtttgagaatgcagcgcgtgttgttgcttgtacgggcggctccacgaatgcgggcctgcaccttcctgcgatggcgcatgaagcgggcattgatttctatcttgaagatgtttgcgatatttttcgcgacacgccttatttcgtcgatctcaagcccggtggtcagtatgtcgccaaagatctctatgaggcgggcggcgttcccgttgtcttgaacgaactgcgccgtgctggcttgctgcatgaagactgcatgaccgcgacgggctattccattggtgaagaactcgacatgcacacactgaaggctgatggccgcgtggtttatcccgttgaaacgccaatcactaagacgggtggcgttgtgggtctcaagggcaacctcgccccagaaggcgcaattgtgaaggttgcaggcatggcagcacagcaccagcgtttcgtcggccctgcccgcatctttgaatgcgagcaagacgccttcgaggcggttcaaaaccgtacgtataaagagggcgatgttttcgtgatccgtaacgagggccctgcaggcggtccgggcatgcgcgaaatgttggcaacaacagctgcgctttccggtcagggcatgggtctgaaggtagcactgatcactgacggtcgtttctctggcgcaacccgtggcttctgtgtgggtcacgttggtcccgaagctgcacatggcggtccgattgccctgctccagcaaggtgacgtgatcacgcttgatgcggttgaaggtacgttggacgtggatatttctgacgaagagatggccaagcgccgtgccgattggaaaggcccgcgtgagacgatctatgcctctggcgcgctttggaagtatgcggatcaagttggcgagatctacaagggcgcggtcacgcatcctggcggcaaggcagaaaagcatgcgtattgggatctgtga

SEQ ID NO: 587 - protein, 572 aa, Candidatus Pelagibacter sp
MAKFNKKKLPSRHTSLGADRAPHRSFYYAMGETEKDVAKPFVGVVSTWNEAAPCNIALMRQAQSVKKGVRANGGTPREFCTITVTDGIAMGHEGMKSSLISREVIADSAELTVRGHCYDALVGIAGCDKSLPGLMMSMVRLNVPSVFIYGGSILPGRYKGKDVTVVDVFEAVGKHSSGQMSAVELRKLELVACPSAGACGGQFTANTMACVSEAIGLALPYSAGTPAPYEERDKYAKESGKTVMNLLQKGIKPRDIVTKKALENAATIVAATGGSTNAGLHLPAIANEAGIKFDLMDVAKIFKRTPYLADLKPGGKYVAKDMWLAGGVPMLLKTLYEGGFIHGDCMTVTGKTMKENLKNIKFNPKQKVMRSYKDPLSPTGGVVGLKGNLAPEGAIVKVAGLKKLQFTGKARCFDNEESAMKAVQSKKYNDGDVIIIRYEGPVGGPGMREMLSTTGAIYGQGKGEKVALITDGRFSGATRGFCVGHVGPEAALGGPIGLLRTGDIIDIDAKKGTIDVRLSKKELASRKRNWKARKSDFGSGTLWKYAQTVGPAYLGAPTHPGKKKEVKDYSEI

SEQ ID NO: 588 - DNA, 1719 bp, Candidatus Pelagibacter sp
atggcaaaatttaacaagaagaaacttccaagtagacatacatcgttaggagcagatagagctcctcatagatcgttttattatgcaatgggcgaaactgaaaaagatgtggcaaaaccgtttgtaggtgttgtatcaacttggaatgaagctgctccttgtaatattgctcttatgaggcaggctcaatctgttaaaaaaggagtgagagctaatggaggaactccaagagaattttgtacaattacagtaacagatggtattgcaatgggtcatgaaggaatgaaatcttctttaatttccagagaagtgatcgcagactctgctgaactcactgtaagaggacactgttatgatgctctagtcggtattgctggatgtgataaatcattaccaggattaatgatgtctatggttagattaaacgttccaagtgtttttatttatggaggatcaattcttccagggagatataaaggtaaagatgtaactgttgttgatgtatttgaagctgtaggaaagcattcatcaggtcaaatgtctgcagttgaacttagaaaactagaattagttgcttgtccaagtgctggtgcttgtggtggtcaatttacagcaaacactatggcatgtgtatctgaagcaattggtttagcacttccttattctgcaggaacaccagctccttatgaggaaagagataaatacgcaaaagaaagtggtaagacagttatgaacttacttcaaaaaggaattaaaccaagagacattgtaaccaaaaaagcattagagaatgctgctacaatagttgctgcaactggtggatctactaatgcaggattacatttgcctgctattgcaaatgaagcaggaattaaatttgatttaatggatgttgctaaaatttttaaaagaactccttatcttgcagatttaaaaccaggtggaaaatatgttgcaaaagatatgtggttagcaggtggtgtgccaatgcttttaaaaactttatatgaaggtggttttattcatggagattgcatgactgttactggtaaaaccatgaaagaaaatttaaaaaatattaaatttaatccaaaacaaaaagtgatgagatcttacaaagatcctttatcacctacagggggagttgttggcttaaaaggtaatttagctcccgaaggtgcaattgttaaagttgcaggattaaaaaaattacaatttactggtaaagcaagatgctttgataatgaagaaagtgcaatgaaagcagttcaaagcaaaaaatataatgatggtgatgtgatcataattagatatgagggtccagtaggtggtcctggtatgagggaaatgctatcaacaacaggtgcaatctacggacagggaaaaggggagaaagtagctcttattacagatggtaggttctctggtgctacaagaggcttctgtgttggtcacgtaggccctgaggccgctctagggggtcctataggcctattacgtactggtgatatcattgatatcgatgccaaaaaaggaactatcgatgtaagactatctaaaaaagaattggcttcaagaaagagaaattggaaggctagaaaatcagactttggatctggcacattgtggaaatatgcacaaactgttggtccagcttatttaggagcaccaactcatccaggtaagaaaaaagaagtcaaggattattcagaaatttaa

SEQ ID NO: 589 - protein, 559 aa, Chitinophaga pinensis
MELNKYSKTLTQDPTQPATQAQLYALGLTEEDLKKAQVGIASMGYDGNPCNMHLNDLAQEVKKGVWANNLVGLTFHTIGVSDGMTNGTPGMRYSLVSRDLIADSIETVVGAQYYDGVITVPGCDKNMPGSLIAMGRLNRPSIMVYGGSTAPGKYQGKDLNIISAFEALGQKMAGQLSDEDFKGIVQHSCPGAGACGGMYTANTMSSAIEALGMSLPYSSSNPALSKDKKEECLSAGKYIHILLEKDIKPSDIMTLEAFENAATVVMALGGSTNAVLHFIAIAKAIGVKFGLPEFQRISDKTPLIADLKPSGKYLMEDLHNIGGVPLVMKYLLKKGYLHGHCLTVTGKTLAENLESVPDLEFEGQDIVVPVEKPIKATGHIQMLYGNLAELGSVAKITGKEGLSFRGPARVFEGEYELIAGIQNGRVKAGDVVVIRQVGPKGAPGMPEMLKPTSAIMGVGLGKSVALITDGRFSGGTHGFVVGHITPEAVEGGTIGLVQDNDIIEIDAEKNTINVELSAEELAARRAKWVKPALKVTNGVLYKYAKLVSNATEGCVTDEA

SEQ ID NO: 590 - DNA, 1680 bp, Chitinophaga pinensis
atggaattaaacaaatacagcaaaacgctcacgcaggatccaacacagcccgccacacaggcgcagctgtacgcactcggtttaactgaagaagacctgaagaaagcgcaggtaggcattgccagtatgggctatgacggtaatccatgtaacatgcacctcaatgacctcgctcaggaggtcaagaaaggggtctgggctaataatctggtcggactcactttccatactattggcgtcagcgatggtatgacaaatggtactccgggtatgcgttattccctggtcagccgcgacctgattgctgattccatcgaaaccgttgtaggcgctcagtattatgatggtgtgatcaccgtacctggctgtgataaaaacatgcctggctccctgatcgcgatgggacgtctgaatcgtccttctatcatggtatatggcggttctacagctcctggtaaataccagggaaaagacctgaacattatctctgcatttgaagcgctgggtcagaaaatggctggtcagctcagcgatgaagacttcaaaggcattgtacagcattcctgccctggcgccggcgcctgtggcggtatgtatacggcaaataccatgtcttctgctattgaagcattaggtatgagccttccttatagttcttctaaccctgcactcagcaaggacaaaaaagaagaatgtctgtcagctggtaaatatatccacatcctcctggagaaagatatcaagccttctgatatcatgacgctggaagcatttgaaaatgcggctaccgttgtgatggcactgggtggtagtaccaatgccgtactgcacttcattgcaatcgcaaaggcaataggcgtgaaattcggattacctgaattccagcgtatcagcgataaaacaccactgatcgctgacctgaaaccaagtggtaaatacctgatggaagacctgcacaacattggcggcgttccattagtaatgaaatatctgctgaaaaaaggctacctgcatggtcactgtctgacagtaaccggcaagaccctggcagaaaacctggaaagtgtaccagatctggaattcgaaggacaggatatcgttgttccggtggaaaaaccaataaaagcgactggtcacatccagatgctgtatggtaacctggcagaactgggttccgtagccaagattaccggtaaggaaggactgagcttccgtggtcctgcgcgtgtgtttgaaggtgaatatgaactgatcgcaggtattcagaacggtcgtgtgaaagcaggcgatgtggtggtaatcagacaggtaggtccaaagggcgcacctggtatgccggaaatgctgaaaccaacatccgctatcatgggtgtaggtcttggtaagagcgtagcgctgattacagacggacgtttctctggtggtacacacggttttgtagtaggacacatcacaccggaagcggtagaaggtggtactatcggactggtacaggacaatgacataatagaaattgacgccgaaaagaatacaatcaacgtggaactgagtgcagaagaactggctgcccgcagggcgaaatgggtaaaacctgcgttgaaagtaactaatggtgtattatataaatatgcaaaactcgtttcaaatgcaacagaaggatgtgttaccgatgaagcctga

SEQ ID NO: 591 - protein, 561 aa, Alcanivorax sp.
MSDSKDDPRRRHSAKVVDGPGKSASRAMLRAVGFTDEDFHKPQVGIASTWSQVTPCNSHIGELADKACEGADAAGGKGVIFNTITISDGIANGTEGMKYSLVSREVIADSIETVAACEGFDGLVTLGGCDKNMPGCLMGMARLNRPSVFVYGGTIMPGKGHTDIVSVFEAMGAHSRGDMDLIELKQIEETAIPGPGSCGGMYTANTMASAIEALGMSLPGSSAQNAVSEEKREDCVRAGAAVLKLLEQDIKPSDIMTRAAFENAITVVIALGGSTNAVLHLIAMARTVGVALSLDDFTEIGKRVPVLADLRPSGHYMMSELVAIGGIQPLMKILLEAGLLQGDCLTVTGRTLAENLADVAPYPLDQSIIAPLSEPLKAESHLRILYGNLAPDGAVAKITGKEGTHFSGPARVFGSEEEAQQRINDGTVVSGDVVVIRYEGPRGGPGMREMLTPTSAIMGRGLGNEVALITDGRFSGGSHGFVVGHVTPEAFDGGPLALLEDGDLITIDAQDNTLVVDLSDAELARRRANWKQPAPRYTRGVLAKYARLVGSASEGALTDQD

SEQ ID NO: 592 - DNA, 1686 bp, Alcanivorax sp.
atgagtgactcaaaggacgatccgcgtcgccgccattcagcaaaggtcgttgatggccccggtaaatccgccagccgggccatgctgcgggcggtgggatttaccgatgaggatttccacaaacctcaggtggggatcgcgtccacctggagccaggtgacaccctgcaacagccacattggtgagctggccgacaaggcctgcgaaggggctgatgcggccggcggcaagggcgtgatttttaacaccatcactatttccgatggcatcgccaacggcaccgaagggatgaagtattcgctggtctcccgcgaggtgattgccgactccattgaaaccgtggcggcctgtgaagggtttgacggcctggtgaccctgggcggctgcgacaagaacatgcccggttgcctgatgggcatggcgcggctgaatcgccccagtgtgttcgtctacggcggcaccatcatgcccggcaaggggcacaccgatattgtctccgtgttcgaagccatgggcgcccattcccggggcgacatggatctgatcgagctcaagcagattgaagaaaccgccatccccggcccgggctcctgtggcggcatgtacaccgccaacaccatggcctcggccatcgaagcgctgggcatgagcctgcccggcagctcggcacagaacgcggtgtccgaggaaaagcgggaagattgcgtgcgggccggcgccgctgtattaaaactgctggaacaggacatcaaaccgtccgacatcatgacccgcgcggcgttcgagaatgccatcaccgtggtgattgctctgggcggctccaccaatgcggtgctgcacctgatcgccatggcgcgcaccgtgggcgtggcgctgtcactggatgacttcaccgaaatcggcaagcgggtgccggtgctggcggacctgcgccccagtggccactacatgatgagcgaactggtggccattggcggtattcagccgctgatgaaaatactgctggaggccggattattgcagggcgattgcctgacggtgaccggccgaacgctggcggaaaacctggccgatgtggcgccctatcccctggatcaatccatcattgcgcccctgtccgagcctctgaaagcggaaagtcacctgcgcattctctatggcaacctggcgccggacggcgcggtagcaaaaatcaccggtaaggaaggtactcatttttccgggccggcacgggtgttcggttccgaagaagaagcccagcaacggattaacgacggcacagtggtgtctggcgacgtggtagtgattcgctatgaaggcccccgcggtgggccgggcatgcgtgaaatgctcacccccacctctgccatcatggggcgcggcctgggcaatgaggtggcgctgatcaccgatggccgcttctccggcggcagtcatggttttgtggtcggccacgtgaccccggaagcgttcgatggcggcccgctggcgctactggaagacggcgacctgatcaccattgatgcgcaggataacaccctggttgtggatctctccgatgcggagctggcacgccggcgagccaattggaagcaaccggcaccacgctatactcgtggcgtgttggccaaatacgcacggctggtcggctccgccagcgaaggcgcgctgacggatcaggactga

SEQ ID NO: 593 - protein, 575 aa, Micrococcus luteus
MDSAASTPSTPSAAPDMKPRSRDVTDGMERTAARGMLRAVGMGDEDFGKPQIGIASSWNEITPCNLSLDRLAQASKDGVHAAGGYPLEFGTVSVSDGISMGHEGMHFSLVSREVIADSVETVMMAERLDGSVLLAGCDKSLPGMLMAAARLDLASVFVYAGSIMPGVARLTDGTERQVTIIDAFEAVGACARGLMSEEDLLRIEKSIAPGEGACGGMYTANTMASIGEALGMSLPGSAAAPSADRRRDAFARRSGEAVVNMLRQGITARDIMTKPAFENAIAVTMAFGGSTNAVLHLLAIAREAGVDLQLSDFNRVADRTPHIADLKPFGQYVMTDVDRIGGVPVVMKALLDEGLLHGDTLTVTGKTLAENLAALDPDPVDGKVIRTMDDALHPNGGIAILHGSLAPEGAVVKSAGFDADVFEGTARVFDRERAAMDALEDGTIAAGDVVVIRYEGPKGGPGMREMLAITGAIKGAGLGKDVLLITDGRFSGGTTGLCIGHIAPEAAEGGPIGLVQDGDRIRVDIAGRTMDLLVDEAELAARLESWEPVAPKFTTGVLGKYAKLVHSAAEGAYLG

SEQ ID NO: 594 - DNA, 1728 bp, Micrococcus luteus
atggactccgccgcgtcgactcccagcaccccgtccgccgcccccgacatgaagccgcgctcgcgcgacgtcaccgacggcatggagcgcaccgccgcccgcggcatgctccgcgcggtcggcatgggggacgaggacttcggcaagccgcagatcggcatcgcctcgtcctggaacgagatcaccccctgcaacctctccctggaccgcctcgcccaggcctcgaaggacggtgtccacgccgccggcggatatccgctggagttcggcacggtctccgtctcggacggcatctccatgggccacgagggcatgcacttctccctcgtctcccgcgaggtgatcgccgactcggtggagaccgtgatgatggccgagcgcctggacggctccgtcctgctcgccggctgcgacaagtcgctgccgggcatgctcatggccgccgcccgcctggacctggcctccgtgttcgtctacgccggctcgatcatgccgggcgtcgcccgcctgaccgacggcaccgagaggcaggtgaccatcatcgacgccttcgaggcggtcggcgcctgcgcccgcggcctcatgtccgaggaggacctgctccgcatcgagaagtccatcgccccgggcgagggcgcctgcggcggcatgtacaccgccaacaccatggcctccatcggcgaggccctcgggatgtccctgcccggttccgccgccgccccctccgcggaccgtcgccgtgacgccttcgcgcgccgctccggcgaggccgtggtgaacatgctccgccagggcatcacggcccgggacatcatgaccaagcccgcgttcgagaacgcgatcgccgtgaccatggccttcggcggctccaccaacgccgtgctgcacctgctcgccatcgcccgggaggcgggcgtcgacctgcagctgtccgacttcaaccgcgtcgccgaccgcaccccgcacatcgccgacctcaagccgttcggccagtacgtcatgacggacgtggaccgcatcggcggcgtccccgtggtcatgaaagccctgctggacgagggtctgctgcacggggacaccctcaccgtcaccggcaagaccctcgccgagaacctggcagcgctcgatccggacccggtggacggcaaggtcatccgcaccatggacgacgcgctgcaccccaacggcggcatcgcgatcctccacggatcgctggccccggagggcgccgtcgtgaagtccgccggcttcgatgcggacgtcttcgagggcaccgcgcgcgtcttcgaccgtgagcgcgccgccatggacgccctcgaggacgggaccatcgccgccggcgacgtcgtggtcatccgctatgagggcccgaagggcggcccgggcatgcgcgagatgctcgcgatcaccggcgccatcaagggggcggggctgggcaaggacgtcctgctgatcaccgacgggcgcttctccggcggcaccaccggcctgtgcatcggccacatcgcccccgaggccgccgagggagggccgatcggcctggtgcaggacggcgaccgcatccgcgtggacatcgccggacgcaccatggacctgctcgtggacgaggccgagctcgccgcccgcctcgagtcctgggagccggtggcgccgaagttcaccacgggcgtgctgggcaagtacgccaagctggtgcactccgccgccgagggcgcctacctgggctga

SEQ ID NO: 595 - protein, 564 aa, Verrucomicrobiae bacterium
MSDQVKSTRPHSAALVDGHDRAPARSMLRAVGFTDEDFKKPQIGIASTGSDLTPCNMHIDELAEHATKGASEGGGKPVNFSTITISDGISMGTKGMRYSLVSREVIADSIETVMAGESIDGLVAIGGCDKNMPGCMIALARLNRPAIFVYGGSILPGLHKEKPVDIVSVFEAVGRHAKGEIDDAELKDIESCAIPGAGSCGGMYTANSMATAIEALGMSLPGSSAQLAVGQEKREDCVNAGKQVNKLLELDLKPRDIMTKAAFENAIKTCIALGGSTNIILHLLAIAHAADVDLSIDDFERLGEQIPLLADVKPFGKYNMSHLIRIGGIQPMMKILLDRGLLDGSCITVTGKTVAENLKDVQPYSKDQDIIRDWDNPIKSTSHLRVLRGNLAPTGAVGKITGKEGLHFKGTAKVYENEEDSLEGILRGDVVAGDVVVIRNEGPVGGPGMREMLSPTSAVAGKGLIMDVALITDGRFSGGSHGFDVGHITPEAACGGPIGIVKTGDEIEIDAVKNTISLNIPQDEYDARMAAFVPSGPGEKRGVLGKFAKLTASASEGAVSDKYL

SEQ ID NO: 596 - DNA, 1695 bp, Verrucomicrobiae bacterium
ttgagcgaccaagtaaaatccacccgccctcactccgcggccctcgtcgatggccacgaccgcgccccagcccgctccatgctccgcgccgtcggcttcacggacgaagatttcaaaaagccccaaatcggcatcgcctccaccggcagcgacctcaccccgtgcaacatgcacatcgacgagctcgccgaacacgccaccaaaggcgccagcgaaggcggcggcaaacccgtaaacttctccaccatcaccatttccgacggcatctcaatgggcaccaaaggcatgcgctacagcctcgtttcgagagaagtcatcgccgactccatcgaaaccgtcatggcaggcgaaagcatcgacggactcgtcgcgatcggtggttgcgacaaaaatatgccgggctgcatgatcgccctcgcccgcctcaaccgccccgccattttcgtctacggcggatccattcttcccggcctccacaaggaaaagcccgtcgatatcgtctccgtcttcgaagccgtcgggcgacacgccaaaggcgagatcgacgacgccgagctcaaggacatcgagtcctgcgccatcccgggcgccggatcctgcggcggcatgtataccgccaattccatggccaccgccatcgaagccctcggcatgtcgctgccgggctcctcggctcagctcgccgtcggacaagaaaaacgcgaggactgcgtcaacgccggcaaacaggtcaacaagctcctagagctcgacctcaagccacgcgacatcatgaccaaggcggccttcgaaaacgccatcaagacctgcatcgcgctcggcggttcgaccaacatcattcttcacctcctcgccatcgcccacgcagcggacgtcgatctctccatcgacgacttcgaacgcctcggcgagcaaattcccctcctcgcggacgtgaagcctttcggcaagtacaacatgtcccacctcatccgcatcggcggcatccagccgatgatgaagatcctcctcgaccgcggactgctcgacggctcctgcatcaccgttaccggcaaaaccgtcgccgaaaacctgaaagacgtacagccgtattcgaaagaccaggacatcatccgcgattgggataatcccatcaaatccacttcccacctccgcgtcctccgcggaaacctcgctcccaccggtgccgtcggcaaaatcaccggcaaggaaggactccactttaagggcaccgccaaagtctacgaaaacgaagaagactctctcgaaggtatcctgcgcggcgacgttgttgcaggcgacgtagtcgtcatccgcaacgaaggtcccgtcggcggtcctggcatgcgcgaaatgctttccccgacttccgcagtcgcgggcaaaggacttatcatggacgtcgccctcatcaccgacggacgcttctccggaggctcgcacggcttcgacgtcgggcacatcactccggaagccgcgtgcggcggaccgatcggcatcgtcaaaaccggcgacgaaatcgaaatcgacgccgtcaaaaacaccatctcgctcaacattccgcaagacgagtacgacgcccgcatggccgcattcgtcccctccggcccgggcgagaaacgcggcgtcctcggaaagttcgccaagctcaccgcctccgcctcagaaggagccgtcagcgacaagtacctctga

SEQ ID NO: 597 - protein, 561 aa, Synechococcus sp.
MSDNRKSQVVTQGVQRAPNRAMLRAVGFQDGDFKKPIVGLANGYSTITPCNMGINTLAIRGEAALKEAGAMPAMFGTITISDGISMGTEGMKYSLVSREVIADSIETACTGQSMDAVLAIGGCDKNMPGAIIAIARMNIPSIFVYGGTIKPGHLDGEDLTVVSAFEAVGQYSAGKIDKERLDAVERHACPGAGSCGGMFTANTMSSAIEAMGLSLPGSSTMAAEDEEKAVSTEKSAFALVEAVRKQILPKDILTRKAFENAIAVIMAVGGSTNSVLHLLAIAHTIGVKLTIDDFEAIRNKVPVFCDLKPSGRYVATDLHKVGGIPQVMKMLLNEGLLHGNALTISGQTIAETLADIPDHPPTDQDVIRPFNQPMYAQGHLGILKGNLAPEGAVSKLTGIKNRSITGPARVFESEEECLDAILANKIKAGDVIVVRYEGPKGGPGMREMLAPTSAIIGAGLGDSVGLITDGRFSGGTYGMVVGHVAPEAAVGGTIGLVKEGDSITIDADKLLLQVNVADEELAQRKSQWSPPQPRYDRGVLAKYAKLVSSSSKGAVTDKDLF

SEQ ID NO: 598 - DNA, 1686 bp, Synechococcus sp.
atgtcggataatcgcaaaagtcaggtagtcacccaaggcgttcagcgggctcctaaccgagcgatgctgcgagctgtcggcttccaagatggtgattttaaaaagccaattgtcggccttgccaatggctatagcaccatcacgccttgcaatatgggcatcaataccctggcaattcgcggcgaagccgcactaaaagaagcaggtgcaatgcccgcaatgtttggcaccatcaccatcagcgacggcatttcgatgggaacagaggggatgaagtactccttggtttctcgtgaggtgattgccgattcgattgagaccgcctgcactgggcagagcatggacgcggtgctagcaattgggggctgcgacaagaatatgccaggagcgattattgcgatcgctcggatgaatattccttctatttttgtctacggcggcacgatcaaacccggtcatttagacggcgaagatctaactgttgtcagtgcctttgaagcagtcggtcaatacagtgctggcaaaattgataaagagcgactagacgcggtagagcgacatgcttgtccgggggcgggttcttgcggtggcatgtttaccgcgaacaccatgtcttctgcaatcgaagcgatgggcctgagtttgccgggttcttcgaccatggctgcagaggatgaggaaaaggcggtcagcactgagaaatctgcctttgccctcgttgaagcagttcgcaagcagattttgcccaaggacatcttgacgcgaaaggcattcgaaaatgcgatcgcggtgattatggccgtaggcggatcgaccaattcggttttgcacttgcttgcgatcgcccacactatcggcgtaaaactgaccattgacgacttcgaggcaattcggaacaaagttcccgtcttctgcgacctcaagccttcaggccgctacgtcgccactgacttgcataaagtgggtggcattccccaggtgatgaaaatgctgctaaacgaagggctgcttcacggcaacgcgctcaccatcagcggccaaaccatcgccgagactttggccgatatccctgaccatccccccaccgaccaggatgtgatccgccccttcaaccagccgatgtatgcccaagggcaccttggcatcctcaaaggcaatctcgcccccgaaggcgcagtctccaaacttactggtatcaaaaaccgcagcatcacaggcccggctcgcgtctttgaatctgaagaggagtgtctagacgcgattttggccaacaaaatcaaggcaggcgacgtgattgttgtgcgctacgaagggccaaaaggcgggccggggatgcgtgaaatgctcgctcctacttctgccattatcggtgctggactgggtgactctgtgggtctaatcaccgacggtcgcttctcgggcggtacctacggcatggtcgttggtcacgtggcgcctgaggccgctgtcggcggcactattggcctagtcaaagaaggcgattctatcaccatcgatgcggataagctgctgctgcaggtgaacgttgctgatgaagaactcgcgcagcgcaaaagtcaatggagcccaccgcagccccgttacgaccgaggcgtattagcgaagtacgcaaagttagtgtcctccagtagcaaaggcgcagtgaccgacaaagacctgttctag

SEQ ID NO: 599 - protein, 579 aa, Brevundimonas sp.
MTQDSTSEPNKPNARSAAVTHGPNRAAARSYLRAAGMQDADFDKPMIGIVNTWSTVTPCNMHLDRLAKDVRAGIVAAGGYPVDFNTIVVTDGISMGTAGMKASLISREVVADSIELAIEGHQLDGVVCIVGCDKTIPAAAMALARMDIPGLVYYGGTIMPGVIGSREVSVQEVFEAIGAHSAGTLDDAGLKAVESAVCPGAGACGGQFTANTMAMALSVMGISPMGANDVPAVDPGKAAQGERCGRLIVERVFAGDTARKYITRASLKNAAVAVSASGGSTNAVMHLTAIAAEAGVDFGVEDCHQACVEAPVICDLKPGGRFLASHLFAAGGTRLVTQRMAEAGKIVNTPTVSGRSLFAEAAEAEETPGQVVVTTFDAPVMERGSFAVIYGDVAPEGAVIKLTGHKVDRFEGPACVFDSEEDAFHAVQDGSVGEGDVIIIRYEGPKGGPGMREMLQVTAALKGRKIDNVALLTDGRFSGASYGFVAGHISPEAAVGGPIALIRDGDRITIDVTNRRIDVNVDLATRRAGFTPHVVRPARGVFAKYRASVASAAQGAVTIPNPPPAQVPASHKSAAAQDA

SEQ ID NO: 600 - DNA, 1740 bp, Brevundimonas sp.
atgacgcaagattctacctcagaacccaacaagcccaatgcgcgcagcgcggcggtgacgcatggtccgaaccgggccgccgcccgctcgtatctgcgcgccgccggcatgcaggacgccgacttcgacaagccgatgatcggcatcgtcaacacctggtcgacggtcacgccgtgcaacatgcacctggaccgcctggccaaggatgtgcgcgccggcatcgtcgcagcgggcggctatccggtcgatttcaacaccatcgtcgtcaccgacggcatctcgatgggcacggcgggcatgaaggcctcgctgatcagccgcgaggtcgtcgccgactccatcgaactggccatcgagggccatcaactggacggcgtggtctgcatcgtcggctgcgacaagaccattcccgcggcggccatggccctggcccggatggatatccccggcctggtctattacggcggcaccatcatgcccggcgtgatcgggtccagggaggtctcggtccaggaggtgttcgaggccatcggcgcccattcggccgggacgctggacgacgcggggctgaaggcggtcgagagcgcagtctgccccggcgccggcgcctgcggcggccagttcacggccaacaccatggccatggccctgtcggtcatgggcatctcgcccatgggcgccaatgacgtgccggcggtcgatccgggcaaggcggcccagggcgagcgctgcggtcgcctgatcgtcgagcgggtgttcgccggcgacaccgcccgcaaatacatcacccgcgccagtctgaagaacgccgccgtagccgtttccgcctcgggcggttcgaccaacgccgtcatgcacctgacggccatcgcggcggaggccggggtcgatttcggcgtcgaggactgccaccaggcctgtgtcgaggcgccggtcatctgcgacctgaagccgggcggccgcttcctggcctcgcacctgttcgccgccggcggcacccgtctggtcacgcagcgcatggccgaggccggcaagatcgtgaacaccccgaccgtcagcggccgcagcctgttcgccgaagccgcagaggccgaggagacccccggccaggtggtggtgacgaccttcgacgcgccggtcatggagcgcggcagcttcgccgtcatctatggcgacgtcgccccggaaggcgcggtcatcaagttgacgggccacaaggtcgacaggttcgaaggtccggcctgcgtcttcgacagcgaggaagacgccttccacgcggtccaggacggctcggtcggcgaaggcgacgtcatcatcatccgctacgaagggcccaagggcggtccgggcatgcgcgagatgctgcaggtcaccgccgctctgaagggccgcaagatcgacaatgtcgccctgctgaccgacggccgcttctcgggcgccagctacggcttcgtcgccggccacatctcaccggaagccgccgtgggcggcccgatcgctctcattcgcgatggtgaccgcatcaccatcgacgtcaccaaccgccgcatcgacgtcaacgtcgatctggcgacgcgccgggcgggctttacgccccacgtggtccgcccggcgcgaggtgtcttcgccaaataccgcgcctcggtcgcctcggcggcccagggcgcagtcaccattcccaacccgccgccggctcaagttccggcgtctcacaaatccgctgctgctcaggacgcctga

SEQ ID NO: 601 - protein, 561 aa, Dyadobacter fermentans
MATELNRFSKTLTQEVTNPAAQAMLYGIGLKEEDFVKPQIGIASTGYEGNPCNMHLNGLSVYVKQGVTANDMVGLIFNTIGVSDGMTNGNDGMRYSLPSRDIIADSIETVVAAQWYDGVIAVVGCDKNMPGAIMAMARLDRPAIMVYGGTIRSGHYKGQKLDIVSAFEALGKKFANNISDEDYKGVIQNSIPGQGACGGMYTANTMASSIEAMGLSLPFSSSYPATHEGKQEECKKIGAAMKKLLELNITPKDIITKKSLENALTVVMALGGSTNAALHYLAIARAAGIPLTLDDIQAISDRTPFIADLKPSGKYFMEDILEIGGVPAVTKYLYSVGLIHGDCITVTGKTVAENLAEAPDLNFETQKMVFPIETPIKKTGHIQVLYGNLAPQGAVAKITGKEGLTFDGEAKVCEHESEIIDMLAKGEIKAGHVVVIRNAGPKGGPGMSEMLKPTSAVMGAGLGDKIALITDGRFSGGTHGFVVGHITPEAFDGGPIALVKDGDRISIDANTRVLTLHISDEEMAARKAAWVQPAPRFTKGMLGRYIRTVKSASEGCVTDEA

SEQ ID NO: 602 - DNA, 1686 bp, Dyadobacter fermentans
atggcgacagaattaaacagattttcgaagacccttacccaggaagtaaccaatcccgccgcacaggccatgctttatggaattggtttgaaagaagaagactttgtgaaaccccagatcgggattgccagcacaggatatgaaggtaacccgtgcaacatgcacctgaacggcctttcggtgtatgtgaaacagggtgtgacagcgaatgatatggtgggtctgatcttcaacacgatcggcgtgtcggacgggatgaccaacggtaacgacggaatgcgctattcgctgccaagccgcgacattatcgctgattcgatcgaaacggtggtggctgcgcaatggtacgatggtgtgattgcggtggtgggttgtgataaaaacatgccgggagccattatggcgatggcgcgcctggaccgtccggcgattatggtgtatggcggaacgatccgctcggggcattataaaggacaaaagctcgacatcgtgtcggcatttgaagcgctgggcaagaagtttgccaacaatatttctgatgaagattataaaggtgtaattcaaaattcgatccccggccagggtgcctgcggcggtatgtatactgctaatacgatggcttcctcgatcgaagcaatgggattgagcctgccgttcagcagctcttacccggctacgcacgaaggcaagcaggaagaatgcaaaaaaatcggcgcggcaatgaagaaattgctcgaactgaacattacaccgaaagatattattaccaaaaaatcactggaaaacgcattgactgtcgtaatggcgctcggcggctctaccaacgcggcattgcactacctggcgatcgcacgcgcggcgggtattccattgactttggacgacattcaggctatttccgaccgcacgccgtttatcgccgatttgaaacctagcggtaaatacttcatggaggatatcctggaaatcggcggtgttcctgcggtaaccaagtatttgtattccgtaggtttgatccacggagattgcattacggtaacaggtaaaacagtggctgaaaaccttgccgaggctcctgacttgaattttgaaacacagaaaatggtgttcccgatcgaaacaccgatcaagaagaccggccacattcaggtgctttacggtaacctggctccccagggtgcggttgcgaaaatcaccggtaaggaaggtctgacgttcgacggcgaagcgaaagtgtgcgagcacgaatcggagatcatcgatatgctggccaaaggcgaaatcaaagccggccacgtggtggtgatccgcaatgcaggtccgaaaggtggtccgggcatgtcggaaatgctgaaaccaacctctgccgtaatgggtgcaggattgggcgacaagatcgcgttgatcaccgacggtcgtttctcgggcggcacgcacggcttcgtggtaggtcacatcaccccggaagcattcgacggcggccctatcgcattggtaaaagacggcgaccgcattagcatcgacgccaacacccgcgtactgaccctgcacatttccgacgaagaaatggcagcccgcaaagccgcctgggtacaacccgcgccacgctttacaaaaggaatgctgggaagatatatcagaaccgtgaagtcggccagcgaaggctgcgtgacggacgaagcgtaa

SEQ ID NO: 603 - protein, 561 aa, gamma proteobacterium
MALNRRSKNITEGVQRAPNRSMYYGMGYEAADFNKPMVGIANSHSTITPCNAGLQPLADAAQEGLREAGANPQIFGTPTISDGMSMGTEGMKYSLVSREVIADCIETCVGGQWMDGVLVIGGCDKNMPGGMMGMLRANVPSIFVYGGTILPGRHNGQDLNIVSVFEAVGEHAAGRIKDEDLLAIERNAIPGTGSCGGMYTANTMSSAFEALGMSLPYSSTMANVESEIKESAKQSALALVEAIRQDIKPRDIVTRESLENAVSVIMATGGSTNAVLHFLAIAHAAEIDWSIDDFERIRQRVPVICDLKPSGQYLAIDLHRAGGIPQVMKILLDGGLLHGDCMTVTGKTIAELLADVSATPAADQSVIRTLDNPMYAKGHLAILRGNLAEEGAVAKITGLKNPAITGPAKVFDDEQSALDAILANKVEAGDVVVLRYLGPKGGPGMPEMLAPTGALVGQGLGESVGLITDGRFSGGTWGMVVGHVAPEAYAGGLIGLVEEGDSITIDAHTLTLQLNVDDAEIARRRSHWTQPAPRYTRGVLAKFAKNAASASRGAVLDLYEE

SEQ ID NO: 604 - DNA, 1686 bp, gamma proteobacterium
atggcgcttaaccgtcgatccaaaaacatcaccgaaggcgtgcaacgtgcgcccaaccgctctatgtattacggcatgggttatgaggcggcggattttaataaacctatggtgggtattgccaattcgcattctacgattacgccctgtaatgctggcttgcagcccttggcggatgcggcccaggagggtcttagagaggccggagcgaacccacagatttttggtacgcccacgatttccgacggcatgtccatgggtaccgagggcatgaagtactcgctggtatccagagaggtgattgcggactgcatcgagacctgtgtgggtggccagtggatggatggcgtactggtgatcggcggttgtgacaagaatatgcctggcggcatgatgggtatgctccgcgccaatgttccatcgatttttgtctacggcgggaccattcttcctggtcgtcacaacggtcaggatctgaacattgtgagcgtgtttgaggcagtgggagagcatgcggccgggcgaatcaaagacgaggacctgttggccattgagcgcaatgcgataccgggtaccggatcctgcgggggtatgtacaccgctaacaccatgagctctgccttcgaagcgctgggcatgagtctgccgtattcctcgaccatggccaacgtggagtccgagatcaaagagtctgcaaaacaaagcgcattggccctggtagaggcgattcgtcaggacatcaagccccgggacattgttacccgggagtcccttgagaatgcggtttcggtaatcatggccacgggtggttctaccaacgccgtgctgcacttcctggcgattgcccacgcggcagagatcgactggagcattgatgactttgaacgtattcgccagcgcgtgccggtgatatgcgaccttaagcccagcggccaataccttgccatcgatttgcatcgtgcggggggaattccgcaggtcatgaagattctcctggacggcggcctgctccacggcgattgcatgaccgtgacgggcaagaccattgcggagttactggctgatgtgtccgccacgccggcagcggatcagtcggtgattcgtacgctggataatcccatgtacgccaagggtcatctggcaattctgcgcggcaacctggcagaagagggcgctgtggccaaaatcacgggcctgaagaatcccgctatcaccgggccggccaaggtctttgatgacgagcagtctgccctggatgctattttggccaacaaagtagaagccggtgatgtggttgttctgcgttacctgggtcccaagggcggaccgggtatgccggagatgctggcgcccacgggtgcgctggtgggccaggggctgggggagtccgtagggcttatcaccgacgggcgtttttccgggggcacctggggcatggtggtcgggcatgtagcaccggaagcctatgccggcggcttgattggtctggtagaagagggagactccatcactattgatgcgcataccctgacgctccaactcaacgttgatgatgcagaaatcgcacggcgccgcagtcattggactcagccagcgcctcgttacacacgcggcgtgctcgccaagttcgcaaagaacgcagccagtgcgagtcgcggtgctgttcttgatctttatgaagagtaa

SEQ ID NO: 605 - protein, 561 aa, gamma proteobacterium
MASNRRSKNITEGVQRAPNRSMYYGMGYKAEDFKKPMVGIANAHSTITPCNAGLQVLADAAEIGLKEAGANPQIFGTPTISDGMSMGTEGMKYSLVSREVIADCIETCVGGQWMDGVLVIGGCDKNMPGGMMGMLRANVPSIFVYGGTILPGRLNGEDLNIVSVFEAVGEHAAGRIKDEDLLAIERNAIPGTGSCGGMYTANTMSSAFEALGLSLPYSSTMANVEDEIKDYAQQAATALVEAVRLDLKPRDIMTREALENAVAVIMATGGSTNAVLHFLAIAHAGEIEWNIDDFERVRRKIPVICDLKPSGKYLAIDLHRAGGIPQVMKILLEAGLLHGDCMTITGKTVAENLADIPATPPADQSVIRPIEKPMYAEGHLAILRGNLAEEGAVAKITGLKNPQITGPARVFDDEQSALEAILAGQIKAGDVVVLRYLGPKGGPGMPEMLAPTGALVGQGLGESVGLITDGRFSGGTWGMVVGHVAPEAYAGGLIALVEDGDTITIDAHQLLLNLEVPKAEIERRRANWVKPPPRYTRGVLAKFARNAASAAYGAVLDGEGS

SEQ ID NO: 606 - DNA, 1686 bp, gamma proteobacterium
atggccagcaaccggcgctcaaaaaatattaccgagggtgttcaacgcgcccccaatcgctccatgtactacggcatgggttacaaggcagaggatttcaagaagcccatggtgggtatcgccaatgcccactcgaccatcacgccgtgtaatgccggtttgcaagtgttggctgacgcggctgagatcgggcttaaggaggcgggtgcaaatccacagatctttggtaccccaaccatctccgatggcatgtccatgggcaccgaggggatgaagtactcgctggtctcccgtgaggtcatcgccgactgtatcgagacctgcgtcggcggccagtggatggatggcgtactcgttatcggtggctgcgacaagaatatgcccggtggcatgatgggcatgctgcgtgccaacgtgccgtcgatctttgtttacggcggcaccattctgcccgggcgtctcaacggcgaggacctcaatatcgtcagcgtcttcgaggccgttggcgagcatgcggcggggcgcatcaaggatgaagatctgctcgccatcgagcgcaatgcgatcccgggtacagggtcctgcggcggaatgtataccgccaataccatgagttcggcctttgaagcgctcggcttaagcctgccttactcctccaccatggccaatgtcgaggacgagatcaaagactacgcccagcaggcggcgacggcgctggttgaggcggtacgactcgatctgaagccgcgggatatcatgacccgcgaggcgctggaaaacgccgtggccgtgattatggccaccggcgggtccaccaacgcagtgctgcattttctggcgatcgcccacgccggcgaaatcgagtggaacatcgatgattttgagcgtgtgcggcgcaagattccggtgatctgtgatctgaagcccagtgggaaatacctggcgatcgacctgcatcgcgccggtggcattccccaggtcatgaagattttgctcgaggccgggctactgcacggcgactgtatgacgatcaccggtaaaaccgtggcggaaaatctcgccgatattcctgcaacaccaccggcggatcagagtgtgatccgccccatcgaaaagcccatgtatgccgaaggtcacctggcgattttgcgtggaaatcttgcggaagagggcgctgttgccaagatcaccgggctcaagaatcctcagatcaccggtcccgcgcgggtgtttgacgacgagcagtcggcgctcgaagctattcttgcggggcagattaaagccggcgatgtggtggtattgcgctacctcggcccgaagggcggtccgggcatgcccgagatgctggcacccacgggtgcgctggtagggcagggtctgggtgagtcggtagggttgattaccgatggccgtttttccggcggcacctggggcatggttgttgggcacgtggcgccagaggcctacgcgggcggcttgatcgcgctggttgaagatggcgatacgatcactatcgatgcccaccagctgctgctgaacctcgaggtgccgaaggcggagattgagcggcgccgggccaactgggttaagccgccaccgcgttacacccgcggggtgctcgcgaaatttgcccgcaacgcggcgagcgccgcctacggtgccgtgcttgatggcgaggggtcctga

SEQ ID NO: 607 - protein, 556 aa, Cyanobium sp.
MLRSDAITQGVQRSPNRAMLRAVGFGDDDFGKPIIGIANGYSTITPCNLGLNDLTRRAEQAAQAAGAMPQTFGTITVSDGISMGTEGMKYSLVSREVIADSIETACNAQSMDGLLAVGGCDKNMPGAMLAMARMNIPAIFVYGGTIKPGRLGPCDLTVVSAFEAVGQFSGGRIDESELLAIEKNACPGAGSCGGMFTANTMSSAFEVLGLSLPYSSTMAAEDPEKAESAARSAEVLVQAIAADIRPRDLLTREAFENAISVIMAVGGSTNSVLHLLAIARTAGVELSIDDFERIRQRVPVICDLKPSGRYVTVDLHRAGGIPQVMKLLLDAGLLHGDCRTIEGKTLTEVLASVPSDPPADQDVIRPLSNPLYARGHLAILKGNLAEEGAVAKISGVKTPVITGPARVFESEESCLAAILAGGIQPGDVVVVRNEGPVGGPGMREMLSPTAAIIGQGLGESVALITDGRFSGGSYGLVVGHVAPEAAVGGTIGLVHEGDSITVDANQLLIQLNVPDEELAARRAAWVKPEPRYRTGVLGKYARLVSSSSLGAVTDLA

SEQ ID NO: 608 - DNA, 1671 bp, Cyanobium sp.
atgctccgttccgatgcgatcacccagggcgtccagcgctcgcccaaccgggccatgctgcgggccgtgggtttcggggatgacgacttcggcaagccgatcatcgggatcgccaacggctacagcacgatcacgccctgcaacctcggcctgaacgacctcacccgccgggcggagcaggccgcccaggccgccggggccatgccccagaccttcggcaccatcacggtgagcgatggcatctcgatgggcaccgaagggatgaagtactccctggtgagccgcgaggtgatcgccgattcgatcgaaaccgcctgcaacgcccagagcatggacggcctgctggctgtgggcggctgcgacaagaacatgcccggcgccatgctggccatggcccggatgaacatcccggctatcttcgtgtacgggggcaccatcaagcccggcaggctggggccctgtgacctcacggtggtgagcgccttcgaggcggtcggccagttctccggcggtcgcatcgatgagtccgaactcctcgcgatcgagaagaacgcctgtcctggtgccggcagctgcgggggcatgttcaccgccaacacgatgagttcggccttcgaggtgctgggcctcagccttccctacagctccaccatggcggcggaagatccggagaaggcggagagcgccgcccgttccgccgaggtgctggtgcaggccatcgccgccgacatccgtccccgggacctgctcacccgggaggccttcgagaacgccatcagcgtgatcatggccgtgggcggttccaccaactcggtgctgcacctgctggccatcgcccgcaccgcaggggtggagctcagcatcgacgacttcgagcggatccgccagcgcgtgccggtgatctgcgacctcaagcccagcggccgctatgtgacggtggacctgcatcgggccgggggcattccccaggtgatgaagctcctgctcgacgccggtctgctgcatggcgactgccgcacgatcgaaggtaagaccctcacggaggtgctggcttcggttcccagtgatccccccgccgatcaggacgtgatccgtccgctcagcaaccccctctatgccagggggcacctggccatcctcaagggaaatctggcggaggaaggggcggtggccaagatctccggggtgaagaccccggtgatcaccggcccggcccgggtgttcgagagcgaggagtcctgcctggccgccattctggccggcggcatccagcccggcgacgtggtggtggtgcgcaacgaggggccggtgggcgggcccggcatgcgcgagatgctgagccccacggccgccatcatcggccaggggctgggcgagagcgtcgccctgatcaccgacggtcgcttctccggtggctcctacggcctggtggtgggccatgtggccccggaggccgccgtggggggaacgatcggcctggtgcacgagggggacagcatcaccgtggatgcgaaccagctgctgatccagctgaacgtgcccgacgaggaactggctgcccggcgggctgcctgggtgaagcccgagccccgctaccgaaccggtgtgctcggcaagtacgcccggctggtgagcagcagcagcctcggtgcggtgaccgatctggcctga

SEQ ID NO: 609 - protein, 540 aa, Jonesia denitrificans
MLRAVGLGDDDFAKPQIGVASSWNEITPCNLSLDRLAGAVKEGVHAAGGFPLEFGTISVSDGISMGHEGMHYSLVSRDVIADSVEVVMEAERLDGSVLLAGCDKSLPGMLMAAARLNVSSVFLYAGSIMPGWVKLSDGTEKDVTLIDAFEAVGACVRGLMSREDVDRIERAICPGEGACGGMYTANTMAAVAEALGMSIPGSAAPPSADRRRDMFARRSGQAVVDLLNAGITARDIMTKPAFENAIAVVMALGGSTNAVLHLLAIAHEAEVDLSLDDFAAVARRVPHLADVKPFGRYVMNDVDRIGGIPVVMKALADAGLLDGDCLTVTGRTVAENLADIAPPDPDGVILRVMDQPIHPTGGITILHGSLAPEGAVVKSAGFDRSVFTGTARVFEGERAAMDALEDGTIRAGDAVVIRYEGPKGGPGMREMLAVTGAIKGAGLGRDVLLLTDGRFSGGTTGLCVGHIAPEAVDGGPIALVRDGDTIRLDVDAGTLDVLVDEGEMAARAVDWVPASRPVKRGVLAKYAQLVGSASRGAVLG

SEQ ID NO: 610 - DNA, 1623 bp, Jonesia denitrificans
atgttgcgcgcagtcgggttgggcgatgatgattttgccaaaccccaaattggggtggcatcgtcgtggaacgaaataaccccgtgcaacttgtcgttggatcgtcttgcgggggcggtgaaagagggtgtgcacgccgcaggtgggttcccgttggagtttggcacaatttcggtgtcggatggtatctccatgggacatgaggggatgcactattcgttggtttcccgtgatgtcattgctgattctgtggaagttgtcatggaagcggaacgactcgacggttccgtacttctagccggttgtgataagtcgttgccggggatgctgatggcggctgcgcgtctcaatgtctcgagtgtgttcttgtatgccggatcgatcatgccggggtgggtcaaacttagcgatggaacggaaaaagacgtcaccctcattgacgcgtttgaggcagtaggggcgtgtgtgcgcgggctgatgtcacgtgaggatgtggatcgcatcgaacgtgctatttgccctggtgagggtgcatgcggtgggatgtataccgcaaatacgatggctgctgtggccgaggcattgggaatgtcgatcccgggttctgcggcgcctccgagtgcggatcgccgtcgggatatgtttgctcgtcgaagcggtcaggcggtggtcgacttgctcaatgcggggataaccgcacgtgacattatgacgaagcctgcgtttgagaatgctattgctgtggtgatggctctgggtgggtcaacgaatgcggtgttgcatttgttggcgattgctcacgaagctgaggttgatttgtcgttggatgattttgcggcggttgctcgccgcgttccgcacctcgcggatgtgaaaccgtttggtcgttacgtgatgaatgatgtggatcgcatcggtggtatcccggttgtcatgaaggcgcttgctgatgcggggctgcttgatggggattgtctgacagtgacagggcgaacggtggcggagaacctcgccgatattgctcctccggaccctgacggggtcattcttcgggtgatggatcagccgattcatcccacgggagggatcacgattttgcatgggtcgttggcgcctgagggggcggtggtgaagtctgctggttttgaccggtcggtgttcacggggaccgcccgggtgtttgagggggaacgtgccgccatggatgcgttggaggatgggactattcgggctggggacgcggtggtgatccgttatgaggggccgaagggtggccctgggatgcgagagatgcttgcggtgactggcgcgattaagggggctgggctggggcgagatgtgctgttgttgactgatgggcgtttttccggtgggacaacgggactgtgcgtggggcatattgctccggaggctgtggatggtggccctattgcgttggtgcgtgatggggacacgatccggttggacgtggacgcgggcactctcgatgtgcttgttgatgagggggagatggcggcccgggctgttgattgggttccggcatcgaggccggtcaagcgcggcgtgttggcgaagtacgcacaacttgttgggagtgcgtctcgaggtgcggtccttgggtga

SEQ ID NO: 611 - protein, 579 aa, Brachybacterium faecium
MDADDETTAPATTRDSAPDIKPRSRQVTDGLGATVSRGMLRAVGMGDADWDKPQIGIASSWNEITPCNLSLDRLAQAAKEGVHSGGGYPLQFGTISVSDGISMGHDGMHYSLVSRDLIADSVETVMSAERLDGSVLLAGCDKSLPGMLMAAARLDLASVFVYAGTIMPGRVSLSTGEEKDVTIIDGFEAVGACARGLMSREDVGRIERSICPGEGACGGYYTANTMSTVAEAIGMSIPGSATPPSADRRRDADARRAGEAVVGMLRQGITSHDIMSKAAFENAIAVVQAFGGSTNAVLHLLAIAHEAEVDLTLDDFARIGAKVPHLADLKPYGRYVMNDVDHVGGIQVVMKTLLDEGLLDGDCLTVTGRTIAENLEVLQPRPADGTVLRPASAPIAPTGGITILHGSLAPEGAVVKSAGFEEDVFEGTARVFEREQHALDALNDGTIDHGDVVVIRYEGPKGGPGMREMLAITGAIKGAGLGKDVLLMTDGRFSGGTTGLCVGHIAPEAVDGGPIAVVRDGDRIRLDVSTGALDLLVDEEELAARWEGWEPLPPKFTKGVLGKYVQLVKSASRGAILGE

SEQ ID NO: 612 - DNA, 1740 bp, Brachybacterium faecium
atggacgccgacgacgagaccactgcccctgccaccactcgggattccgcccccgacatcaaaccgcgcagccgccaggtcaccgacggcctgggcgcgacggtctcgcgcggcatgctgcgcgcggtgggcatgggtgacgctgactgggacaagccgcagatcggcatcgccagctcctggaacgagatcaccccctgcaacctgtcgctggaccgcctcgcgcaggcggcgaaggagggggtgcattccggcggcggctacccgctgcagttcggcaccatctccgtctccgacggcatctccatggggcacgacggcatgcactactcgctcgtctcccgcgacctgatcgccgacagcgtcgagacggtgatgagcgccgagcggctcgacggctcggtgctgctggccggctgcgacaagtccctgcccggcatgctgatggccgcggcccgtctggacctggccagcgtgttcgtctatgcgggcacgatcatgccgggccgggtctccctctccaccggagaggagaaggacgtgacgatcatcgacggcttcgaggccgtcggcgcctgcgcgcgcgggctgatgagccgggaggacgtcggccgcatcgagcgctcgatctgcccgggcgagggcgcctgcggcggctactacacggccaacaccatgtcgacggtcgccgaggccatcggcatgtcgatccccggctccgccactcccccctcggccgatcgccgccgcgacgcggacgcacggcgcgcgggcgaggccgtggtcggcatgctccgccagggcatcaccagccacgacatcatgagcaaggccgccttcgagaacgcgatcgcggtggtccaggccttcggcggctcgaccaacgcggtgctgcacctgctcgcgatcgcgcacgaggcggaggtggacctcaccctggacgacttcgcccggatcggcgcgaaggtcccccacctcgccgatctcaagccctacggccgttacgtgatgaacgacgtcgaccacgtgggcggcatccaggtggtgatgaagacgctgctggacgagggcctgctggacggggactgcctgacggtcaccgggcgcacgatcgccgagaacctcgaggtgctgcagccgcggccggccgacggcacggtgctgcgcccggcctcggcgccgatcgcccccaccggcggcatcacgatcctgcacggctccctggcgcccgagggcgcggtggtgaagtccgccggcttcgaggaggacgtcttcgagggcacggcgcgcgtgttcgagcgcgagcagcacgccctggatgccctgaacgacggcaccatcgaccacggcgacgtggtggtgatccgctacgagggccccaagggcgggcccggcatgcgcgagatgctcgcgatcaccggcgcgatcaagggcgcgggcctgggcaaggacgtgctgctgatgaccgacggacgcttctccggcggcaccaccgggctgtgcgtcgggcacatcgcgcccgaggccgtggacggcggcccgatcgccgtcgtgcgggacggggaccggatccgcctggacgtgagcaccggggcgctcgacctgctcgtggatgaggaggagctggccgcccgctgggagggctgggagccgctgccgccgaagttcaccaagggcgtgctgggcaagtacgtgcagctggtgaagtccgcgtcccgcggagcgatcctcggggagtga

SEQ ID NO: 613 - protein, 561 aa, Paenibacillus sp.
MANGKDLRIRSKVISEGVNRVPNRAMLRAVGFTDEDFKKPMIGVASTWSEVTPCNMHINDLAAQAKLGVRNHGGAPLIFNTITVSDGISMGHGGMLFSLPSREAIADSIEIVTGAERFDGIVAIGGCDKNTPACLMAIGRMNLPAVYVYGGTIQPGNLDGKKVDIVTAFEAVGQYHDGRMTDEQLHKVECSVCPGPGSCGGMYTANTMAAAAEAMGMCLPGSSSTPAISPDKAAECAAAGKQVISLLEQEIYPKDIMTRKAFENAITVVMALGGSTNAFLHLLAIAHSVGVDLTLDDFEQIRLRVPHLADLKPSGRYAMQDLNDIGGVPGVMKLLLAEGLLHGDCLTVTGKTLAENLADIAPLQQDQDVIRPFDNPLKPNGPLVVLKGNLAPEGAVAKMSGMKKLRFVGPAKVYDSEEDATEAILRNEIRKGDVLVIRYCGPKGGPGMPEMLSVTALIVGKGLGGEVALLTDGRFSGGSHGFVVGHVSPEAQVGGPIAVLRNWDIVTIDSETQEIMFQVTDEELAARTQAWVQPPLKVSSGVLVKYARLVSSASKGAVTDL

SEQ ID NO: 614 - DNA, 1686 bp, Paenibacillus sp.
atggcaaatggaaaagatcttcgaatccgcagcaaggtaattagcgagggagtcaatcgggtgccaaacagggcgatgctgcgcgccgtaggttttactgacgaggatttcaagaagccgatgattggcgtagccagtacctggagtgaagtcactccgtgcaatatgcatatcaacgacttggccgctcaggctaagcttggagttcgcaatcacggcggcgcacctctgatttttaatacgattacggtttcagacggtatatccatgggacatggaggcatgttgttctccctgccgagcagggaagcaattgcagattccattgaaattgtaaccggcgccgaacggtttgacggtatagtggcaattggcggttgcgacaaaaacactccagcctgtctgatggcaatcggtcgaatgaatctcccggccgtttacgtgtatggaggaaccattcaacccggtaatttggacgggaagaaagtcgatatcgttacggcttttgaagcggttggccaatatcatgacggaaggatgacagacgagcagcttcacaaggtcgaatgcagcgtatgtccgggtccaggctcttgcggcgggatgtataccgctaatacgatggctgcagcggcggaagcaatgggcatgtgtctcccgggctcttcatccacgccagctatttctccagacaaagctgcggaatgcgcggcagccggtaaacaggttatttcgctgctggaacaggagatttatccgaaagacattatgacaaggaaagcgttcgagaatgcgattacggtcgttatggcgttgggaggctcaaccaatgcattcttgcatctgctcgccattgcgcactcggtaggcgttgatctaactttggatgattttgagcagattagacttcgcgtacctcatctggcagacctgaagccaagcggccgatatgccatgcaggatttaaacgatattggcggagttccgggcgtcatgaagttattgcttgctgaaggccttcttcacggggattgcctaaccgttaccggtaagactctggcggaaaatttagccgacatagctcctctgcaacaggaccaggacgttattcgtccatttgacaatccgctgaagccaaacgggccactggtagtccttaaaggaaatctggctccggaaggggccgttgccaagatgtcaggcatgaaaaaactgaggtttgtcggaccggcaaaagtgtacgacagcgaggaggacgcaaccgaagccatcttgaggaatgagatccgcaaaggagacgtattggtgattcgatactgcggacctaagggtggaccaggcatgccggagatgttatccgttaccgcattgattgtaggcaaagggcttggcggggaagttgctctgctcacggatggacgattctctggcggctcgcacggatttgtagttggccatgtttctccggaagctcaagtaggtggaccaattgcggtgcttaggaattgggacatcgtaacgattgacagcgaaacccaagagatcatgttccaagtgacagatgaggaattggccgcccggacgcaagcatgggtacagccaccgctcaaagtaagctcaggcgtattagtaaagtatgcccgactggtgtcctcagcttctaaaggagcggttactgatctttaa

SEQ ID NO: 615 - protein, 577 aa, Octadecabacter antarcticus
MTRKATDKTNLPSRHVTEGPSRAPHRSYFYAMDLTEEQINQPFVGVATCWNEAAPCNISLNWQARSVKRGVKEASGTPREFTTITVTDGLAMGHEGMRSSLASRDAIADTVELTMRGHCYDAIVGLAGCDKSLPGMMMAMVRLNTPSVFMYGGSILPGRHEGKDITVQDMFEAVGKYQAGQMTDAELAVMERVACPSAGACGGQFTANTMACVSEAIGLALLNSSGMPAPYEDRAQYGEASGQAVMNLIAKNIRARDVVTRKSLENAARVVACTGGSTNAGLHLPAIAHEAGIDFNLFDVCDIFRDTPYFVDLKPGGQYVAKDMFEVGGVPVVMKELRKAGLWHDDCMTASGKVIGEELDMIKGEADGKVIYPVENPITKTGGVVGLKGNLAPDGAIVKVAGMSDDEQVFTGPARVFESEEDAFSAVKARCYKEGEVLVIRNEGPSGGPGMREMLATTAALSGQGMGKKVALITDGRFSGATRGFCVGHVGPEAAHGGPIGMLKDGDMITMNAVSGELSVDLTDAELAQRKADWVGPKETIYASGALWKYAQLVGGALNGAVTHPGAKHERHIYMDL

SEQ ID NO: 616 - DNA, 1734 bp, Octadecabacter antarcticus
atgacccgcaaagcaaccgacaagacgaacctgcccagccgccatgtcacagaaggcccgtcgcgcgcgccgcatcggtcgtatttctacgcgatggacctgaccgaagagcagattaatcaaccatttgtcggcgtggccacctgctggaacgaagcagcgccttgtaacatttcactgaactggcaggcccgatcggtcaaacgtggtgtcaaagaagcaagcggtacgccgcgcgaatttaccaccatcaccgtcaccgatggccttgcgatgggccacgagggcatgcggtcgtcgttggcatcgcgcgatgcgattgcggacacggttgaattgacgatgcgcggccattgctatgatgcgattgtcggtctggcgggctgcgacaaatccctgccggggatgatgatggccatggtgcgtctgaacacgccgagtgttttcatgtatggtgggtcgatcctgccgggtcgccacgaaggcaaagacattaccgttcaggatatgtttgaggctgttggcaaataccaagcgggtcaaatgacagacgctgaattggctgtgatggaacgggttgcatgcccgtctgcgggtgcctgcggtggtcagtttacggccaacacgatggcttgcgtttctgaggcgatcggcctcgcgcttttgaattcatccggcatgcccgcgccctatgaagaccgggcgcaatacggtgaggcgtcgggccaagcggttatgaacctgatcgcaaagaacatccgcgcccgcgatgtggtgacgcgcaagtcgctggaaaatgcggcacgtgtcgtcgcctgtacaggtgggtcgaccaatgctggcctacacctgcctgcaattgcacatgaagcgggcatcgatttcaacctgttcgacgtttgtgacattttcagagacacgccgtattttgtcgatcttaagccgggtggtcagtacgtggcaaaagacatgtttgaggtcggcggtgtgcctgtcgtgatgaaagaattgcgcaaagcgggcctgtggcatgacgattgcatgacggccagtggcaaagtcatcggcgaagaattggacatgattaagggtgaggctgatggcaaagttatttaccccgttgagaacccgatcaccaaaactggcggtgttgttggattgaagggtaatcttgcccctgatggtgccatcgtgaaggtcgctggcatgtctgacgacgaacaggtctttaccggtcctgcgcgggtgttcgaatcagaagaggacgctttttcggctgtgaaggcgcgctgctataaagaaggtgaagtgctggttatccgcaacgaagggccgtccggtggcccgggaatgcgtgaaatgctggcgacaacggcggcgctgtccggtcagggcatgggcaagaaggtcgcgctgatcactgatggtcgttttagtggcgcaacgcggggcttttgcgttggccacgtcgggcctgaggccgcacatggtggcccgattggtatgctgaaagacggtgacatgatcacgatgaacgcggtgagcggggaactatcggtcgatctgacagatgcagaactggcgcaacgcaaggcggattgggttggcccgaaagagacgatttatgcgtcgggcgcgctgtggaagtacgcgcaactggttggtggcgcgctgaatggcgcagtcacgcaccctggcgcgaaacatgaacgccacatctatatggatctgtaa

SEQ ID NO: 617 - protein, 564 aa, Variovorax paradoxus
MTTPTDPNSKRFRSATIREGTIRATTRSFLHALGQDDEDIARPHIGVFHTGGEMSPCNLNLREQAQHAKIGIYAGGGTPHECPVVSVSDGLTMAHSGMRFSLISRELIADSVEASTRGHQWDGIFAIGACDKNLPGLMMGMVRCNVPSVFVHGGSALPGQMPGPDGRDLNVVDTYETIGKVLAGTATHDELDAMSRACLPTAGACAGQFTANTMGMVSEALGLAPMGSSMVPAVFSERAPLMRRAAKNLMKAVMGDSPLPRDIVTRKALENACAVVSATGGSTNAALHLPAIAHEAGIKFHLDDVAEVFARTPLIADLRPGGQYLARDVFYIGGAGVILRTLMEQGFVHGDALSFTGRTLAEELADAAAPDGRVVRAPGNPITRDGGLAVLKGNLCPDGALLKTAGLQTLVHRGPARVFDSEEQAQAAVQNRRYEAGDVIVIRNEGPKGSPGMREMLGITALLYGQGMGDKVALLTDGRFSGATRGLCIGYAGPEAADGGPIAALQDGDMVAIDARPGARTISVELAAEEIALRLSRRQVNAGVAHRGLLENTRSPCAPPTRAP

SEQ ID NO: 618 - DNA, 1695 bp, Variovorax paradoxus
atgaccactcccaccgatccgaacagcaagcgctttcgctccgccaccatccgcgagggcacgatccgcgccaccacgcgcagcttcctgcatgcgctcggccaggacgacgaggacatcgcgcgcccgcacatcggcgtgttccacaccggcggcgagatgagcccgtgcaacctcaacctgcgcgagcaggcgcagcatgccaagatcggcatctacgcgggcggcggcacgccgcacgaatgcccggtggtgtcggtgagcgacgggctcaccatggcgcattcgggcatgcgcttctcgctgatctcgcgcgagctgatcgccgacagcgtggaggcctcgacgcgcggccaccagtgggacggcatcttcgccatcggcgcctgcgacaagaacctgccgggcctgatgatgggcatggtgcgctgcaacgtgccgagcgtgttcgtgcatggcggctcggctttgcccgggcagatgccgggccccgatggccgcgacctcaacgtggtcgacacctacgagaccatcggcaaggtgctggccggcaccgccacgcacgacgagctcgacgccatgagccgcgcctgcctgcccaccgcgggcgcctgcgcgggccagttcacggccaacaccatgggcatggtgtcggaggcgctgggcctggcgcccatgggctcgagcatggtgccggcggtgttcagcgaacgcgcgccgctgatgcgccgcgccgcgaagaacctcatgaaggcggtgatgggcgacagccccctgccgcgcgacatcgtcacgcgcaaggcgctcgagaacgcctgcgccgtggtctcggccaccggcggctcgaccaacgccgcgctgcacctgccggccatcgcgcacgaggccggcatcaagttccacctggacgacgtggccgaggtctttgcgcgcacgccgctcatcgccgacctgcgcccgggcgggcagtacctggcgcgcgacgtgttctacatcggcggcgcgggcgtcatcctgcgcacgctgatggagcagggcttcgtgcacggcgatgcactcagcttcaccggccgcacgctggccgaggaactggccgatgccgcggcgcccgacggccgcgtggtgcgcgcgcccggcaacccgatcacgcgcgacggcgggctggccgtgctcaagggcaacctctgccctgacggcgcgctgctcaagaccgcgggcctccagacgctggtgcaccgcggcccggcgcgcgtcttcgattcggaggaacaagcgcaggccgccgtgcagaaccgccgctacgaagccggcgacgtgatcgtgatccgcaacgagggccccaagggcagccccggcatgcgcgagatgctgggcatcaccgccctgctctacggccagggcatgggcgacaaggtggcgctgctgaccgacgggcgcttctcgggcgccacgcgcggcctgtgcatcggctatgcggggcccgaagcggccgacggcgggccgattgcggcgctgcaggacggcgacatggtggccatcgacgcgcggcccggggcgcgcaccatttcggtggaactggcagcggaagaaatcgcgctgcggctgtccagacgtcaggtaaacgcgggggtggcgcaccgcggcttgctggaaaatacgcgctcaccgtgcgccccgcccaccagggcgccgtga

What is claimed is:

1. A method for identifying [2Fe-2S] dihydroxy-acid dehydratase (DHAD) enzymes comprising:
    (a) querying one or more amino acid sequences with a Profile Hidden Markov Model prepared using the proteins of SEQ ID NO: 164, 168, 230, 232, 298, 310, 344, and 346, wherein amino acid sequences with an E-value of less than $10^{-5}$ provide a first subset of sequences;
    (b) analyzing the first subset of sequences of step (a) for the presence of three conserved cysteines that correspond to positions 56, 129, and 201 in SEQ ID NO: 168, whereby a second subset of sequences is identified;
    (c) analyzing the second subset of sequences of step (b) for the presence of signature conserved amino acids at positions corresponding to positions in SEQ ID NO: 168, wherein said amino acids are aspartic acid at position 88, arginine or asparagine at position 142, asparagine at position 208, and leucine at position 454, whereby a third subset of sequences is identified;
    (d) expressing a protein having an amino acid sequence identified by step (b) or step (c) in a host cell;

(e) purifying the protein of step (d);
(f) confirming that the protein of step (e) has DHAD activity; and
(g) confirming that the protein of step (f) is a [2Fe-2S] DHAD enzyme by UV-vis and EPR spectroscopy.

2. The method of claim 1, wherein the [2Fe-2S] DHAD enzyme is a bacterial [2Fe-2S] DHAD enzyme.

3. The method of claim 1, wherein the host cell lacks endogenous DHAD activity.

4. The method of claim 2, wherein the host cell is a bacterial cell or a yeast cell.

5. The method of claim 4, wherein the bacterial cell is a member of a genus of bacteria selected from the group consisting of *Clostridium, Zymomonas, Escherichia, Salmonella, Rhodococcus, Pseudomonas, Bacillus, Lactobacillus, Enterococcus, Pediococcus, Lactococcus, Leuconostoc, Oenococcus, Pediococcus*, and *Streptococcus*.

6. The method of claim 4, wherein the yeast cell is a member of a genus of yeast selected from the group consisting of *Saccharomyces, Schizosaccharomyces, Hansenula, Candida, Kluyveromyces, Yarrowia*, and *Pichia*.

7. The method of claim 4, wherein the host cell further comprises an isobutanol biosynthetic pathway.

* * * * *